United States Patent 9,567,581 (SELECTIVE REACTIVATION OF GENES ON THE INACTIVE X CHROMOSOME) - sequence listing, part 40

SEQ ID NO: 4464 - DNA, 2009199 bp, human
tgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaaggtgactcttttggtcaatttgcaacccctgggatatatttggatgactcctgttccatatgcctttctataaaagttaaattggggcttttgttgtgaggaagggaagaaaggggtttgacaccaataacctataggataatgcaaatcactgaaataagaaggaacccatattctactttttgggttgtggctttaatgaactttgtcttcaggtatctaaaattatttctagtatgaagaaaagaaaaaaatatccagaccttaatctataaacgataatatttttacctcaaattaaatttctaaggacgtagactacattcataaactcattagaaaactaatgagggatttttatattaacaatagaaaaacctgtgtttcacatatatatatgggcttatttatgcatatatgtacatatgaatatgtgtatgtgtatatatatacatacacatatacactcacatttttaagaagtttttaatcaaagaagacggaaataacaaggatccttgtgaatagtaatttagacatgtttagacaagcacaacttattaggaagcaaactgggacaattgtaaacagtaattccaggctgcctaattatctgaaatatctcagaatgattttagaggttaaacacttattattaaatggtagcttctaaataaagtgaaaaggtgtagtgatttatcaggtttttttttaattatagaatatcctaaaattctaaattagcatatattctgttgccaatatatactgtcagtatatttgaagtatattaatttctaaattatgttacttttattaaaattccaaagagtttctgacttggacaagttttctctatctttaggaagacagctagtttttttttcaggggggtgagctaaaagagttaggataaagtacaccgcattaaattaaaaacgtgtgttgggaataaagacaatccaaagttaaaagtctatttggatctcaaattttcccataacttgatttgtaagaaaagttacccttttgcaagtcttctctctcatttggtctggactaagtggttgtcatttctcacttacagattgctgttttactaatctctttataaatatattttttaattttatatctgtattttattcatcagattgtcctggaagtacagaggccagttgatggtttatgagttcaagctgagccgaatatagctaagccctgtcttgcctgacatttcatcaaaagctgtgttgatttgcaatgtttaccgacctatttattgaaccttcacagcttgaactatgccaccaagctcgctgacattgctgagattatctctaaatgcatgtacaaactaaggaggaaattgaaaaataagttaaaaacaatcatccgtctatttattaaattatgcttatagagtccttgatttatgtatttgtttgattgttctccgcaaagccccatgacctgatttttctttgatcttcccacacactcttggaagacgatagattagaacagtggttctcactcttccttgagtgggcatcagattcacctggagggctggttaaaccacagcttgctggatgccacccccagagtttctgattcagtccttctgaagtggggccccaacctctgcatttttaacagattttttaggagatgctgatgctgctagattactaagaacagaaaatgagtgttctaatacaaagagcagaaaataattgttcttaatctagttacctgtgttctctttatgcgttgtttagtttacactgtacaagaaaataaacacatatcctcacaaaattgaagcatatattctactaaagattaatatattaaaatattgaataaaatattaaatatctatgttaggaaattgtattcctgctgaaactggcagtaaaattacttaaattacttagcagtaaaattactgttgacaaaagtaaacaattggtcattaggtctcaaatacgtaaaacctcaattttttttttttttcttgagacggagtctcgctctgtcacccaggctagagtgcaatggcacgatctcgggtcactgcaacctccacctcccatgttcaagtgattctcctgcctcagcctcccaaaaccctcaatttttaattactcctttgattcttattctctgcgatttctccctatgtaaagttttagtctattatatttttagtaaaatgaaagcatgatccatgagataagcacttgaatctatactatacatcaaagtctccccttttgggccattaaaactaagatgttttccaacttaccttaccaaagccacagtttgaaaactgaaactatgaaaaaactggatattttgcttaattataatgcttcgtaaaaaattagaacgtctttaaaaatgttaacaactaaagtcaaacattcaaaaattataacctttgctataaagttatatgttcattcattgtagtcactttcttttagtaaaatgtaagcttttgatgtattctaatggggcgcaacgtttagattaaatgtttaatatggataattgacttttaatgaaatttaatctagatgttcgtaactgagagttaggggtgaacatgcctttaaggatgtagacatttttattacaattattttctccatgtttttgattaaacatatcaaggaaatatatattattttttatttaacttttctaatgtattaatttttggccagtcctacctatcacatgcttcagcaataatcagagctttgatgacaatgtcacattattttaattcagatgttattccagtttgataagatggagctgatctttagaaaacaagtgtaccatatttctaatctttaaatattatattgaattatttcagcctggctcacttgccagtttttcccttttgttttcatgattaaagcaactgataattattaacatagataagatttatgacattaatttatggttttcttcataaaaataaagccttttttttttttttttttttttttttagatggactttcgctcttgttgcccaggctggagtgcaatggcgagatttaggctcaccgcaacctccgcctcttgggttcaagcaattctcctgcctcagcctcccgagtagctgggattacaggcatgcaccaccacaccaagctaattttgtatttttaggagagacggagtttctccatgttggtcaggctggtctcgaactcctgacctcaggtgagccacctgcctctgcctcccaaagtgctgggattacaggcgtgagccaccgcacccagccaataaatccattcttaacggaattttagagcataaatctgagaaaagaaactaaggctgtacgtactaggtctcctatacaccttgtctttcatcattgaatccttagtagttaatacctgcttggaatgtaatgggaattcaataaattaattaaataaatggatgagtgaatcctacagacaattttgccaaggaagaaaataaagacagggtatttttatttctttcggttttttttttttttttttttttttttttttttttcagacagagtctccctctattcgcccaggctggagtgcagtggcacgatctcggctcactgcaacctccgcccttcaggttcaagtgattctcctgcgtcagcctcccgaatagctgggactacaggcgcctgccaccacgcccagctaatgtttgtatttttagtagagccgaggtttcaccatgttggccaggcttgtttctaactcctgacctcgtgattcgcatgccttggcctcccaaagtgctggggttacaggcgtgagccaccgtgcctggccagggtatttttatttttattttatttttttgagacagcgtctccctctgtcgcccaggctgaagtgcaatggcactatctgggctcactgcaacctccgcctcctgggttcaagcaattcttctgcctcagcctcccaagtaactgggatataagcattcgccactacgcccagctaatttttttgtatttttattagagacagggtttcaccatgttggccaagctggtctctaactcctgtcctcaagtgatccgcccacctcggcctcccaaagtgttgggattataggagtgactcacaacgcccagccttttatttcaatttttactgctgtttgttttcttccaaatgaataataaatatgacattttattctgatagctattagattatgaattgaatgtgagaacaaaaggcattctggttttcgtttgttttaatattggactgaaaaaaaaaaaaaaaaactcatttgaaccgggcgtggtggctcatacctgtaatcccagcaatttgggaggctgaggtgtacagatcacttgaggtcaggagtttgagaccagcctggccaacatggcgaaaccctgtctctcctaaaaatacaaaaattagccaggttgtggtggcaggttcctgaaatcccagctactcgggaggctgaggcaggagaattgcttgaacccgggaggcggaggttgcattgaaccgagatcgcacccctgcactccagcctgggcgacagaggtagattctgtctcaaaaaaaaacaaaagaaagtagaacaaaaactcatttgagactttcaggatacaataatttgtttaccttttcagttttctgattcctcatggtgaaggaatcatatctcttcagtgacacacaaacacacacaggatatatacagttatgtgttaacaccagggatacattctgatcaatccatactaaggtaatttcatcgttgtgtgaatgtcacagagtgtacttacactaacctacgtggtatagcgtagtgcagacctaggttgtatggtatatcctatttctgtttggctacaaacctgtacagcatgtgactgtactgaatactgtaggcaactgtagcacaatggtaaatatttcaatgtctaaaacatatctaaccattagaaggtacagtaaaaatcccgtgttataatcaaatgggaccactgcggtatatgcagtttatcattgactgaaacatccttatgcagttcctatcttttcttttgggccacacttggaattgaaatggaagctggagaaaggaagaacatgaaataaactgatgtttttccagccagtcaaaactcagcctctgtgttttagagaaagcattcggaacacagttgagagagggagagaaagagaagtggaaggtttagagggaggtccccgcttgtttttatctcttcaagcagctctaaatttgtccaaagcagaaaaagttgtacttcgcttcactctatattcaagactcaaaccaagattaaacatgaacctgtgggaaagttctttttaattaaactcatgttatttgaaaatacattatggtaagatatttttttgaaagttaagagtcagattttgtctgcataatgaaaagtgactaaggagtgctgaagttatcactcaattatcaggaaatctagaaaaattactttccaataaaaatgagcatcaatgatttctaccacagccttttggttaaagagtaatgaggagaaattctgccatgtaattaaagataatgaaattatcaatcaaggctaagctgcattaggttctttgactaaaataattttatacaattttaagtataaattaagttaaaatatatacattgagtgtgtgcattaatgtagacagtgccaaatattcaacaaaattatttcaccacctttgatttttgttttttgttttttgtttgtttgtttgtttgtttttgagacggagtctcactctgtcacccaggctggagctcactggtgcaatctcggctccctgcaacctccacctccaggctcaagcaattctcctgcctgagcctcctcagtaactgggattacaggcatgcaccaccgtgcctgactaatttttatatttttaggagagacggggtttcaccctgttggccaggctggtctcgaactcctgacctcaagtgatctgcccatctcggcctcccaaagtgttgagattacaggcatgaaccaccatggccggctgatttaagcacctttggaatcataattattaatcataaatgaaaccaaactaaaaataaagtataccacatgtgagaacattccaatgaataaaatcatttctgtgtgagctagcctgctgttcaaatttgtttatgcttatgcttcagataatgtttacaaaagtactgacagattcctagaagcacaatttctaaacacttaccttggaggtttctagggccctaaaaatatttctagtcatttcaaaaaaccacaaaacaactacaaaaaatgtacttctcccaaaggccatacgtagcacatgcaaaaagagattctgcagagcattttggaacgtaagtagcttttgtggttctgtgtctcaaattagcctgttcttaaaagtctgcaaattaaaaaagaatgataggccaggcgtggtggctcacgcctgtaatcccaacattttgagaggccaaggtgggcggattacttgaggtcaggatgtcgagacctgcctggccaacatggtgaaaccccgtctctaccaaaaatacaaaaaaattaaccagacatggtggcatgcgcctgtagtcccagctactagggaggctgaggcaggagaatcacttgaacctgggaggcggaggtttcggtgagccaagatagtgccactgcactccagcctgagagacagaggaagactccgtctcaataaaaaaaaaaaaaagaatgataaattgagtcaaaattataaaaattcaacagacgctggcacagatttgagatttgaggaaccagtaaaaaacgtagtacatattgataaatggcaatgtggtgtcaagatattaaaattggttttaatcttattaaccaacataaaatatggaaaacttatacatttaagtgggcccagaaaaaagtttgcaaatagcattccaaaaatcgatagaataatgtgaatgctttgttttctaatcttcacataatagggttggactagatgatttataagatccagtatatagcccctaataataacccctttaaaaagtctttttttttttttttttttttttttttgagagagtcatgctctgtcacccaggctggagtgcagtggcacgatctcagctcactgcaacctccgcctccctgtttcaagcgattctcctgcctcagcctcccgagtagctgggattataggcacacgccaccacacctggctaatttttgtatttttagtagagacggggtttcgccacgttggccaggctggtcttgaactcctgacctcaggtgatccgcctgcctcggcctcccaaagtgctgggattacaggcgtgagccactgtgcctggcctaaaaagtgtttcaatagaggagagaaataaacaagatcctgaagggataagaagatgtaaaagttgttgctgatgttctgccgcatatttctttccccacccgagttccatgcagtatcttgctttgctataaacaggagtaagccagaaatatgaggggttgtgttaatgtcaccagaagcgacctttaactacgaggggatggaagtacttgaaaaaagcacgcagccatctcatcttctggtgcataattctgaggcatgttcctcacagcttctcagagattcaccagcaggactgagccccagaataatgtgctcattgacacacctttgattgcctccttacctttcctaatctcactttctctttcctctcacttgtactttttgtaatcaattgccagataaactgtgtacctgcacctcaaatccttgcctcagtgtctgtctggggagaatctaaagtaacacagaaggttagcgagaaattgtttcacatgcttaaacaaaacagggcaaaggcacttaagatgttagagggagggagggtgaggaaactcacacgggatgacttcactctgtttagtacctaaaagtgaacaggaggtggatcgaaaggaaacagttagtgaacctgcaaatcaataggaagggttagaagactggttatgggagatggaccagatagcccagtaagtgaagaaaaggctcatggaacagcagagaaaatggacatatatcatccatatattttgtttccatcctagtctaatttacccttagatactacaataatcccccaactcatctttgccacttgtgcttttgtccttttctactcactccatactctacatggcctaaaggttgagcttttaaaaacataaaccaggttgtgtcaatctctgattaaaattcgttactgctctgatgcgtccaatatctttaccaagaaccacacttcatttttcttccttttcttctgcagtcttgctgcatttcagccatactgacctgctgccatttctcaaatgccagtctctgtactgctattgcctcttcctggaatgctctcctcatccatcctctaactgccttgatcgccactgaatatacactaacatgcatattgtcagtcacgcagtagtagcttaatatgtatttgcggaataaactaatgggaaagagtaacagcatggttcagttgatggtggataatagtgatttactgagtcacaaacaacatcatctgatgccttagcaaagaggagtaggtattggagaaagaagacaatacttacaattctttacttccttgagctcattttatatgtgtgtgtgtgtatatatatatataaaacatatatatgacatatatgacatatttttgacatatgtcatgttatatgcctccttctctattatatatacaatgtgttcaaggaagtaaagatgttcaataaagttcaaggaagtaaagtctaaggtgtctttgtatgtagcactgaagtgatcagtcagagtccaggcttggctggatatcgaacagtggatgtgtgaagtagaagtgagtgatgccaattttaaagataatgagcagtttagtaggcaaggatttagtgtcagatatggaggttgtggttggcagtagtagtagttgtactgggaagctcttccacagtggtgaagaagcatgctgagaaaggccaaaaagtcaaagtagcatcttgctgtggataaggagattggcataaatggagtaaaagttgagggtgaaaagtgatgtgagacaaggacaaatagacaagttggcttggctaatgtaatacccatgatgtaagaaaagctatgctgagatagctaggctaattccaagggacttttgaggggagcatatcaggttatcacatgccaaaaatgtttcatttcagagactttagtcttctcattaattttatcgctaatccattcattttcaaaatgtatttcaggatttcacatcaggtcgactttaaatcttttgttcagatgaacgtttcttttcctaggactgagtaagacagtttgtcctatccagtgcttaagagtaaagcaagcttatgttgccactgcaggcaggattattaaataaccaattactattcagactgtgtcacatccctttaaattactcaagcaagagtcttggccgggcgcggtggctcacgcctgtaatcccagcactttgggaggccgaggcgggcggatcacgaggtcaggagatcgagaccatcctggctaacacggtgaaaccccgtctccactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagagtcttgaacttgttcagcctgaacacatctgatatcctcagccaagtataggatgtaaattagatagcttctggctttactagtgtggaatcaggcatgctttttccccttaggactccatgactaatgacctgaattgtctacatttcaagactagtcagatctctaatggtgaacctatttcattgtttctgcttctgttttgtcccgtagtatatgagacaaaggatatttttatgtgcaaattgcaacaagttgagatactcctttaaaaatggattttctttccatagttgattagcgtatggtaccagatttcctagaaatgtttttatgataaaagtttcaggttctcgatgatgcaaggaaattacagacgttaggtaatgatttgtaatcaggacacatgagaggagttgtaactttactgcttaccctgtggctttgagaatcattaatcctcaatgggcctcagttttcatatctaaaaatactgctttttaggttcagttacttcaagggtcaaatgagataaaatatatgtgttataacaataaaatgtaataataaatatgaggtaccttttcccccagctttattgaggtataattgacaaatggcgattgggtatattcaaggtgtacaatatgatgatttgatacatatacattctgaaatgattatcacaatcaagttaattaatatatccttcacctcacatagttgccattataattttttatgatgagaacacttaagatctctcttagcaaatttcaagtaacaatagagtactattaactatagtcaacatgctgtacattagatccccagagcttactcatcttataactgagagtttctatccttcgaccagcatttccccatttttttccatccccagttactggctaccactgttccactttgctttgatgagcttaacttctttagataaaatgagttactttttgaaaaacaagtttaattggcaaaattgtatatatgtattgtgtacattatgttaaaaaatatatatatatataatgtggcctggtgaaattgagctataatagtagtgtttttaatgactatgtagccgaaagttccaaggctttcagctgattgactatgtaattcttaaatctagtagagtatcttctgatttgagagcagtatgaatcctggcagaaaactatgctggctatacacttttaagggtttgaactgtgttactttatctatatactctgcataaaatattctctctcctatacaggccagctcatttattcttgcttttctagtctgattccccctttctggaatctttttcctccatcgacttttggttctaaagcattcccatcttcaaaaattcaattcaagtcctagttaccacaacactttctctaacggcttgaaacacctcttttttctatgaacttttgttccacatagttatttctacccagttatcgacataattgcttgctaattatttcctgtggattaactttgattccataactttttaacttttttatagatttcctgagagcacgtgctgtgctttatatttctttgtaaatacctcagtagctctgcattttttttctctgtcatccaggatggagtgcagtggtcgatcatggctgactgaacccttgacctcctgagttcaagtgatcctcccacctcagcctcccgagtagctgggactaccagcgctccaccacacccagctaattttcgtactttttgtagagatggggttttgccttatcactcaggctgatctcaaactcccgagctcaggtgacccacctgcctcagcttcccaaagtgctgggattacaggtgtgagccactgtgcccggccagccctgtggttttttgtcgttgttttggtttttttgagactgggtttcactctgtctcgcaggctgcagtgcagtggcaccatctcggctcactgcaacctctgcctcctgggttcaagcgatttttctgcctcagcctcccgaatagcagggattactggtgcacgccaccatgcctggccaatttttgtatttttagtagagatgggtttcaccatgtgggccaggctggtctcgaactgctgacctcaggtgatcctctgtcctcggcctcccaaagtgctgggattacaggcatgagccgccgtgctcacccagctctgcatttttgaatcattgtttataaaacattgagcatcaaataatatgtttttaaatattgtataagtaatactgtgttcatagaaacgttttcttttggccgggcgcagtggctcacgcctgtaatcccagcactttgggaggccggcggatcacgaggtcaggagatcgagaccatcctggctaacacagtgatacaaaccccgtatctactaaaaatacaaaaaattagccgggcgtggttgcgggcgcctgtagtcccagctactcaggaggctgaggcaggagaatggcgtgaacccaggaggcggagcttgcagtgagccgagaccacgccactgagctccagcctgggccacagagcgagactccatctcgaaaaaaaaaaaaagaaatgttgtcttttacaaccatatatttatcatatttatcagtagtttaggcgtggtcttgaaaaggaacctccccctaccataatgcctttcgtttaggagatccccccattacacttgtggcttacattgaaagaaaaaaaaaattatccccttgtctatggtagaaaactgtgtcattcgtggctttgactgcatcacaatccattttagctttttgtcacttaacttgagaagaaatgaaatatatgtggagtgtatatccctgaagaaagtaaaggaccagctgttatcactatagagtttgtattgttgctgaaaataatctggttatgtttgtaaggattaagtagtttattcaacagatgtttggtagtaaacatgaatgagaaaaggcttgttcttatcatattcattatgaatgctgaggttgtgctttactacatgttttcaatgctcatcctaactgaaagtatgaagtggaaggatcaatttctgaatatttaaatgagatgttgattgccttgttataaacattaacaattttcctaagtgtttgctcttgagatagagcatctttaggagaactttatgatttgggctggcagatttagccaaattaacaggaatgtaccttcctaatgtgatcattcatccctaggaacaggaatctgggaacactgaggctatacttctgtatggtgagttatcaaagtgttaaacacaggcactattaatgaagcacagattctactttcagagtaaagctagtgttactatctatgaaaaaatattattatttatgttttcataataataacttctacattatatttattttcaactttttagaataaatctgagctaggaggttcttattttagttgttttccttctatcgtttttcattacgctcttgttgtttgatttggtctcacattttaaaaagcttactgtataagaaagttttatcttcaaaataatgagcactagaggttactataaatggaaatacaaaatgtggatttactaaagtgttttgacttttacctacacatttcttggagtaatttttaagttgaattttaagaattattttgctggccgggcacggtggtggctcacacctgtaatatcagcactttgggagtctgaggcaggcggatcacctgaggtcaggagttcgagaccagcctggccaacatggtgaaaccccgtctctactaaaaatacaaaatttagccaggcgtggtggtgggcatctgtaatctcagctactcgggaggctgagacaggagaatcgcttgaacccgggaggtggaggctgcagtaagccaagaacatgccactgcactccagcctgggcaaaaaagtgagattctgtctcaaaaaaaaaaaaaaataataataatattgccatatattcgaattacacaataataccagattgaggatattagaggaaaacaaatattatattttcaatatttctaaagtattttttgtcttggttatttttatggaattatattacatttatagtataacctaactcttaaccattttgaggggtaagtttaaagattaacttatcactattgacgaattattcatctacccgtggaagtgtctgcagtttatccatttcgaaacatctaatattacatgagaatttacttttctcattagattacataaacatcatgttaaaatgcaatatgtacatgtgacaactgatcttttgggaaaaaaaaagtccatgaatcactcctgtaacatttggaattaaattcattaaccaaaataatatcatgcttcatcttttatattttgcttccttagcatctggttcttagtctgtctaattacattataatggctctgtgttacaacagttgctagaagatttttttgggggggggggcaagaatgatgattttgcctcatattttggaatacctgctttgcaaatgtctttcctatatactagagccagaaggaaacaaatctaatgtttcttattcgtttgaaatttattgggagaccaacttcattcaaagatcaagaactctaaaatttttacatcaaaaactatttttttccccaattactttgttgagtactgcacttccagtcttgagatcgaaagtaatgttgaggccgggcacggtggctcatgcctgtaatcccagcactttgggcggctgaggcgtgcggatcacctgaggtcaggagtttgagaccagcctggccaacatggtgaaaccccgtctctactaaaaatacaaagaaaattagccaggcatggtggcgggcgcctgttattccagctactagggaggctgaggcaggagaatctcttgaacttgggaggcagaggtcgcagtgagccgagattgagccgctgcactccagcctgggcgacaagagcaaaattccatctcaaaaaaaaaaaaaaaagtaatgtttagccttgaaattgctaatacaatggacggtatccagcatatttcttttttgtatgcaattaatatttttactttatttattttatttatttttttgagatggagtctcactgttgcccaaactggagtgcaatggcgcagtcttggctcactgcaacctctgcctcccaggttcaagtgattctcctgtgtcagcctcccaaagtgctgggattacaggcacgagccaccgcgcctggccgatattcttactttaacagttgaataagttaatattttattggagctatgcaattagttaatttcatatagtgaatatattaatatcttatgaggaagagccacaattttagtataataatgtagataattataactcaggaggactatgatcaagatacactgtaaggatccttcaccatattttaccaaaatattattttatagttcaaagggggataggacggtacacttccaattatgctgcaaatttgttattattactgaaaaagtctattttcttcttcaagcaattaactattaatgtctttaatgtcaataaaccgcatagcgttatagactctctttgaatttctctgaattagaaataatttttgaataggaagattaacacagactcattttaattctgtaatggtagaaataattaatctccccttatctgtagggatacgtgttctaagacccctggtggatgcctgaaactgtggataataccaaaccttatgtatatattatgtttcttatatacatacacatataacaaagtttaatatatacattaggaaccataagagattaacaacaataactaatattagaacaattataacaatatactgtgataaaagttatgtgaatgtggtctctatctctcaaaatatcttattgtactgtactcatctatttttggactgcagttgatcatgggtaaccaaaaccatggataagaggcagactactgtgtattttattatatgcatgttatatataatatatgtaatatatattatttgtatccatttggcaaacaattgagatttttatttcatgtagttgctttttgtactaatatagttatatggttgttggaattatgtcattaaaacacattaagccaagcatgctggctcacgcctgtaatcccagcactttgggaggccgaggcaggtgaatcacttgaggtcaggagtttgagaccagcctggccaacatggtgaaaccccggtctctactaaaaatagaaaaaaaatcagccgggcgtggtggcaggcacctgtaatcccagttacttgggaggctgagtcaggagaatcccttgaaccccagaggcagaggttgcagtgagccaacactatgccatcgcactcgaatcgagcctgggcaacaagaatgaaacttcgtctcaaaaaagaaaaacacacacgcacattaagagaaattatgtttgtcgttttgtttattctctaatttgattaaattgaacagaataataagtcacgtatggcaataccaaatattatgctaaaaataaaacactgaaagctgaaaaattcaatcacagattattggtttatatgacatcaggcttcaggctgataggagacgtccaaatgataggcttattttgttccataagtattgggcacggttcttagtataacaaagaaataaccgtggattgagaaattgttttcctcaccttcattacttaatagtagaattcccttcaatgtgccacttaatattccttgatgtcagagccttccatttgagcagctgaaattattgacacccctctcattcttcaaggatgtgttgtagggactgctgagtttctgtagaggtttaagctttgtgggaaatgatgttgagtatgacaatgttatcagcaacattgtcaacttcatggttgcctattgacttagggaaaagtggagaaaaatatgacaattgctgagtgcttagttgcagtagctttttaattttaattttcaagcatctgtgtataagcaaaagaatatacacagtgccacgtatcatacccattgacaagtttatcagattttaattataataaatattttaattaaaatgttttttaaaattattaattttaatgaacatcaaatttctctcttgtgatgtgataagggcagtgatagaactgacatttgaacgttcaatacacaattcggccaccattcaataggcttggattgtgcccatggttctgttctgtactaaagacacaaagatgaacaaataaaaactctgcccttgaagccatacagtcaaaatacagtgtccttaatctggggtccatgaaccatgataggaaaaaaattacatctttattttcactaacctgtaactgaaaatttgcatttctttccctttatgaagataagcaacacagaacggtattagcaatatctgtgaatttattaccaatatttttatatcaaatcctagttgttttggatatcttgaaaaatcatatgttaatatataccagtggttagtatactaatcactacttttaatttgtattaattattatgcttataactaatgtattaatagcatataatagtattatattcagtattttacaattgcaatataattaatttcctttgttttttatatgcttttagttttcattttgcacatttgaaaacagtctgggaagtgttccatatgcttcaccagatgccaaagggatccatagcacaaaaatagttaaggaccccatatctagaagagacacaggcaagtacatataataccatggtacagaaaaataacagaggcttgtaccatatgctgtgaaattgggcataactctctcagtccaaaggactgaagaggaaatttttgatttggccttgaagcacacgtgattgtttctctagtggtaacatgtgagagagggcattctaaaaaagagaaaagtaggtgcaaagtcgaagtcacccggtgagagcttgcagggtcagggaacaaagagcagtgtactgtggcaatgtaaacaaacaaagaaacaaacaaaaaaaccttttttttttttaaaccattgttgggcatcctattctgttttcatttgtcaatgtgcaagattgcatttgccaagcagtttttattaatcattagtgagtagaaactattctctggctttttattttaactgactatatttcatatagacaacaggcaagaaacatcaaagaagagatcaaagctctgcattagcgttttaaatctcattatttcaaacaacatctacctgtaaggggaaaaaaaaccgtaaatctttttcacctccccacttcgtcgttgttttcagacaacgatcagtcacttgtctggcctgtgggccataattggctacctgtaaatctcaagagactgaaccatgtaactggaataattttttttttttagcactacactacacggctgttattcagttataatggtcaaggaagctttagatgctgtacttaggctttctaaatgtgtgctttatttggctttctgggagaaatgtcaatgtgaatttccagattataatgaagttcatccagaaaaacaactatgatttaaagaagcagaagaaacaaaccggactgaaaaaatacactaatagactaagatagtgttttcaaactgttctagattaagacaattttgcttgcattctttgttgagcaagaaggttcacatcttaacttttccaataatcctctttaagaccgttattattggccttgatttcaaacagaaaccagcagggacctgaatggacactactagttaaccagtctaaagccttatgttaaagctaaacagttatctctaattttcaaaacaatagcatgagtatatattaaaaagtggttgatctagggaacttaatattccaggatgaactatactaaatgaaaatatgtaacacattaaaatgtggtcaaacaagccatctatagctgatagtacaaattgcatatatatctactttattaaaattttaactggccaataaaattgatactataattctaaatataatttttatttaagattacaagttttaaaattgaacagacttaggtttaaatcacttctctctcttcttctttttttttttttttccgaaacggagtttcactcttgttgcccaggctggagtgcaacggcgcgatctcggctcactgcaacctccacctcccaggttcaagcaattctcctgcctcagcctcatgagtagttggccctccaccatgcctggataattttttgtatttgtagtagagacgaggtttcaccatgttggccaggctggtctcaaactcctgacctcaggtaatccgccctcctgggcctcacaaagggctgggattacaggggtgagccaccgcggccagccaaaatcacttcttaaatgtgttattctgggcccagcacggtggatcatgcctgtaatcccagcactttggcaggctgaggcggtccgatcacctgagatcaggagtttgagccagcctggccaacatagtgaaaccccgtctgtactaaaaatacaaaaattagccggcctggtggcacatgcctttaatcccagctactcgggggtgctgaggcaaaagaatcccttgaaaccgagaggcagaggttacagtgagccaagatcatgccactgcactacagcctaggtgacaggtgacagagggatacttcgtctcaaaaaacagaagacaaacaacagcaacagaaaatgtattattttgtattagcttagctcagcatgtttgcttgtatgtaaagtagaactgaaaaaaaaacctaataaaattaaaatagggattaaatgcactaaaatttgttatttgttctacgtatttcaaaaatggtagtcattctaattatttattttagttaatggaaacattagttttattgttagtaaaacaatatattgttgatacaatatctagcataattttgcctcttaatgaatcaatcagcttgtcctttttattcatattttccttaattataaaccaattttttaaaagtcataatctatcagtagaaatggtactttattaaattcggagaatagtatcatttaaggaaaaatattcctagataaaaaaatatacagtactatgaaattcacatgcatttaaagtcattattaatttataaagaatctggaattataacctgaactaaataattctatttttttgctgaatgaatgaataaataaatgaatctttaggaacttgactgtcctccactaaagttaatgactccttcaacatattacacattctgttgctttgttctcatttctattataaatgcaagtttgcttttttgcatatggaatcaccatctataaattcatagtcaatatggggttttaaataatcattaccatggaaattatacttaagtattagttctgttggttggagattatgaatttctaaatttaaaaaaatgctgatttaaatttattatttccagtgccctatcctatttttttttcatatctgctactgccttcctaataaacttgtttagaaatatatcttgacagcaaatggtattttattcctaccctcttggcatgtattatacacaaactttgttttttgttgttgttgctgttttttttgtgtgtgttgggggggggggggggacagagcttcgctcttgttgccgaggctggagtgcaatgatgccatctcggctcactgcaacctccgcctcctgagttaaagagattcttctgcctcagcctcccgagtagctgggattacaggcatccgccaccacagccagctaatttttgtatttttagtagagacggggtttcaccatgttggccaggctggtcttgaactcctgacctcaggtgatccgcccacctctgcctccgaaagtgctgggattacaggcgttgagtcactgcacccggccttaaacttcttttcgaaagctttctcttttatacgtattgagttaattcctgtttgcgctgtgacatctacctgactaccacaaaaccttacagccacttgcttctgtaaatggaaaactgccctagcatgacaggatgtgggctgaagacataaccatatcgaaaacagcaagctttttggaaatctgtgtttggccctcaatttcatggcctcaagtaacttgataattttctatttctaatgcctgtcagccacaacaggatctgataaccaactaaaatctctgttggaagtgaataggggaaaataggtgaaatcacatttgatgttgtaagggaagcttattgaagacagtggatgtgttcaaaacattatgaggcaaataatgaggaggaaaaaatatgaggaaatagatcaccaggaagccctgtgaatgtttatgttttggctttacatgattactagtaattaaattagtgaaaaatattttatggaatattcaatatgcccttaatgtacaatttgctgagcaataagaatataagactacaaacttcctcttattggaatatacattttattttttattttgttgtacttcaatagctttagggtttcaagtggtttttgcttacgtgtatgaattgtataatggtgaagtccgggattttattgagccgtcacccgagtagtgtacgttgtacccaatatgtagttttttatccctcattcccaccccctccacttctgagtctctgaagtcccttatatcactctgtatgcctttgcatactcataagttagttcccattataagtgagaacacacagtatttgattttccatttctgagttacttcacttagaataataacctccagttccatccaagttgctgcagaagacgttatttcattgtttatatggctgagtagtattctatggtgtgtgtgtgtgtgtgtgtgtgtgtgtggtgtgtgtatctcacattttctttatccactctaaggtggattctatatctttgcgattgtgaattgtgctgcaataaacatatgtatgcaggtgcctttttcatatagtgacttatttttattttggtagatatgcagtattaggattcgtggattgaatggtatacctacttctagttctttgagaaatctccatactgttttccagagaggtattaatttacacttccaccagcagtatataagtgttctctttttatcttgtccatgccaacgtttattgttttttgactttttaataatggccattctggctaagataaggaagtatctcattgtggttttaatttgcattcccctgatgattagtgatgttaagtattttttcatgtatttgttgatcatttgtatatcttcttttgagaaatgtatattcttgtcgtttccaagctttttaaagagattgttttcttcttgctgatttgcttgagttctttgtaggttgtagatattggtcagttgtcagatgcagtttgcaaatatttttttccattctgtcggttttctgtttacgttgatggttatttcttttgctgtgcagaagctttttagtttacttagatcccatttgtttatttttatttttgttgcatttgcttttgaggtcttggtcataaattctttacctaggccaatgtccaggagagtttttcctaggttttctttgaggagttttatggtttcaggtcttagacttaagtctttaatcctccttgagctaatttttgtatatggtaggagatagggatccagtttcattcttccacatgtggttgtcccattttcccagcaccatttattgaataggctgtcctttgcccaatttatgtttttgtatgctttgttgaaggtaaattggttttaagtatttggcttcacttctggcttctctattctattccaatggtctatgtaggaatagacgttttaaaatgttgcaattggaactatggataaacctttaagataataatttttagccactgttcattttaactgggggagaatgggaaaaaagtttaatcactttaactaaatcagttactttgtttacatatatttagctctgataattacaaggagattcacttttgagtttgaaaagtagattctaatgcctaatgagagttttcacattgtctttgagaataaacactattttaggttattactgatatttcagtttgtgaactaataattcagcttgtgaattttacccaattttataaattcacttttcttacttgggcgtctgtgtttgaattaagaatggttaaatgtttctttcatacgcgtccgtgtgaagagaccaccaaacaggctttgtgtgagccataaagctgtttatttcacctgggtgcaggtgggctgagtccgaaaagagagtcagcgaagggagataggggtggggccgttttataggatttgggtagataaaggaaaaaggggggttgttctctggcaggcaggagtgggggtcacaaggtactcagtgggggagcttttgagccaggatgagccaggagaaggaatttcacaagacaatgtcatcagttaaggcaggaacaggccattttcacttcttttgtggtggaatgtcatcagttaaggcaggaaccggcaatctggatgtgtacgtgcagatcacaggggatatgatggcttagcttgggctcagaggcctgacagtttctacatgatagtctctttattcaaaagaaacacactacattattattttaaaacgttattaacatatttttctgtgctagaaaattttaagaaacaaacatttaagtgggctaactcatttagaatttgtaaaatatgacaaaactctaggagaaagtttacctgtgaaaggagtctgttatgtaaatcaatagtgtaattatgattcaataaattatataaattcctaatgagcactatcaatttttcttttgctaaaatctactgatattctacttttaaattactctcacttttagtgttcccctgaggacttatcagtttggaacacttaaatttgagttatcgttctgttcttaggaaaaatatatttaaagaaataatgatttattatgctagatttatcattatttttatttgggattgcttttaatgtgcatgagttacaaagacataactgtgagatcccattttctataatttttttagtgattccatacatttctgagtttacattttttaaaaattatagctcaaaaaatgcaagacataagtaagtatgcttttctaatgggtcatttcagtcgcgtccgtgtgaagagaccaccaaacaggctttgtgtgagcaataaagctttttaatcacctgggtgcaggcgggctgagtccgaaaagagagtcagggaagggagataggggtggggccgttttataagctttcggtaggtaaaggaaaattacaaagaggggttgttctctggtgggcaggagtgggggtcacaaggtgctcagtgggggagctttttgagccaggatgagccaggagaaggaatttcacaaggtaatgtcatcagttaaggcaggaacaggccatttccacttcttttgtggtggaatgtcatcagttaaggcaggaacaggccattttcacttcttttgtgattcttcagttacttcaggccatctgggcgtatacatgcaggtcacaggggatatgatggcttagcttgggctcagaggcctgacaggtcagttatggaaacacatcaaagtactctagaaccaaaagttaatttttgaaagaaattaacttaatgtacagattttataggaattctggacgtatttaatatcgtgatgctagaagaatgtcttaccaattaatattactggatttcttgttgtgtatcaagttgtaacagataccttaatcacctaccagataggctcattcctgtgtccattccaatagaactctgattttgctcagatctccatcctcacaatttcacagtagtcttcagtaaagaaatgagactaccccttgtcacagaaaatgaatcatactttaattcgcttatatgcttccataccacttgccatttacgggtttaagtatgtgcatgagatgcaacctgaaccaattaaacatcaagtaagtttttcttgccaatgaaaagcgttcacttaacaactaaatgcttgagcatttatatgtagatatatatgtacatatatacgatgtaaaatgtagaatgcccactgattcatttataatttgatatgtattagtatgtatttaataagctcttataagactgaatggactctggatatgaaataatataccaagtatggtaacacatggtaacacatggacaaattgtagtggaatcaataaagcattcagagaaatacatcattattatttattctcccactttaggaagatttcaatcctagcattaaatgtaacactgtcttttttaaaataaaacctccatttctaagaagttatttgatgagaaaatatttgagaggttatctgatgagaaaatttgaagaaaaaaattttaactgtacaaccagttaattagaactttgtcaaataacattgcctttaattcccagaaatccaatacattatgctcagtgaactgtaacacctgagtttttaaagtggaatacttaaaaaaaaaaaaaaacaaaaaaaaccagccttctggggtaatatctcctctttggaagtttctttttttccaaaattatacttaaaggacgattcttttaatgaataaattttagagttatctcaaggaataaatagaggaaatattattttatttcaaagagaagaatgtctattgtggcaaacaacaaacctgaaataaataaaacgtgacagtctatgaagtccgtgagcctaaagaacaatggttattttactgtcttagaaaagtttaggaagtttggatttgaattcaaactttaatttgaacttataacgtcaacttgaaatcatttggaataaacattgaaaaccttctttgaaagttttatcaaaggagaaagaatttgaataccaagaggatggaaaggttaacttctgttatctgaaatatcttcaattgccttgagccagtttaaaaataaacaagcttactgatatagagggaaacaagtctaccttgtgaatataatttaaaaaagagaaaaaatgtcatttaccatattatttacttcctcattttagaaaagggaataaacatttattaattatgcactatcaggcactacgcattcaacacacactatcacattagttcttcccaaaagccatttgaagtagtttttctttctttttttttcttcttttcttttctttttttgagagatggagtcttgctctgttgcccaggctggagtgcagtggcacgatctctgcccgctgcaacctccgcctccctggttcaagcgattctcctgccttagcttcccaagtagctgggactacaggcatgtgccaccacgcccagctaatttctgtattttttagtagagacggggtttcactatacgttggccaggctggtctcgaactcctgacctcaggtgatccgcgtgcctcggcctcccaaagtgctgagattatgggcgtgagccaccgcacctggcctgaagtagtttctcttatgcccattcatcaatatagataatagggttcagagagatttttcagtaatttacacaagattttacagctcctaggtggcagaatctagacttaaatttagatctgatccaaaaactgtattttcctagctttagtaggacattaacaatacaagtgcctctttaatatgcttaggaatgcatttttatttatatgtaaaaccaaataaacaaataaacgctgcgattgccaacaaagtatctttaatgtaagaatttcaaatgctgtgcaaaattatcctcactaactgctcttctggtcccacacttgtcacatggctacagaatatactatatctctctttctcttccagcagcttcctagtggccacacagggaccatcctatccataggttatagttgctttttaaaatctaggcatttcctaggagctgatgagattttagaagaggtgatattaacatgaaaaaattggtaggggtagatttctgagatattctatccaaattcaggagttttacaattataatttagttaaatattgtacttgatacacatataattccattaatacactctgagttaattgattttcatttattactcatggttttcattttttgttttttgttttttgagacggagttttgctcttgtcacccaggctagagggcaactgtgcaatcttggctcactgcaatctccgcctcctgggttcaagcgattctcctgcctcagcttcccgagtatctgggatgacaggcatgcgccaccatccctgactaattttatattagtagtacagatggggtttcgccattttggtcaggctggtctcgaactcctggcctcaggtgatccacctgcctctgcctcccaaagtgctgggattacaagcgtgagccaccgtgcccggcttcatcgtttccatctttaacaaagaaatacatgatatttaaagaaattttaaaagtataattttaaaacagagggaaagccacccacagctaaaacatcctttctctaaacagtttattttttccttaataaagttagatattttttggtgtctaactttgcattgtaaaacttaatcattacttacattgctccataatattctgtcatatggttttgctgtagaactgatactgagttggtgtgccccttgtaagaatagtccagtcattttaaaccagcatctgtttggattgggccagcatctcttccagtgtccttgagtcaacaatgccttaatggtttctacatatatttttaaatattacctatagatagttcattctttatcttcttatgttgcgtgtcagagctattacgttagagctattatgtaattttggcttttttatatatcattgcaattaacactcttgtccattaatctgtttgggttttttttgttctctagttgacatcttatgacaaatcaataggtgtgtaaactatgtcgatttttcttggctgtaaaaaacagtaaagaatgcttacagtacacgttgtctttatgaaaggaagttccatttgaagaaataattaaaaaacaatctgttttgcctttaatgggcaagatgaagagttaatgccactatatactaaatatcttaatctcgacatgaaatgagaactattctagagatatgtttctagatagatatggaacaaccacaagttcatacaaaatttgttaattttaagtcatattttggacttttattaactcatatggagtgacgaacaaatccttaattaatagcagacatatcatcatctctggatgcttatctatcagagatcagcaagaaaacaaacacacggcatgctaaaatgggtaaactatgagaggcaataagaaacaatattcaaagttgtgggtagggttaagggaaactaatgaatactgtgatgcaggtggcccctggctctggggacaatagaaagacataacccaccactaggcctaaaaaaggtaaaatgtgagggagcaattactagatcctggaaatggaggagctgaggagagaccgcccaacaagagctgtgacctttgaaaaagaaatacagccacttacaacctgagctcttgcaggtgtaaaaagtagaggtttctctccaaagaaactttcctacccatctaaatgggaataaatagtaacgtctcctagaagcaaaatttattaaacgacctgtgctaacattcttaaatatctactagccgtaataaagaaatcaatgtactttatgttcttagttcccacaatttagcctaaatatttgccctggcatgcttatactggtccaagcacgcattaggtcatagcctgttcctcttccttatttgaaggtgtttttacctttctcagcaagtaacttgtggaaacaagttacttcctccttcctttgttctcctctgcctttgtctcttttgaaaagttctaagttgctagccaatcgggacaaatacagaatgtgtggtcctgttccagccaatggaaaccggacacagcagtagagtaaacatgtcaggttataaatgaccctgtctcctttgttcggtgtactctcgtggcaaaactgctggcgagtgtaccctttctgcaaaaagtaaaaatgaccttgctgagagagttaaatttatgttcgagtgctgtttctttgcagcaccagggaacaagcattctgtttctaaataaacattgtttacatataacacagggaaggagcagtaaagaggatacagcctccacacacctttgaaaagcactcaagttataagtctttagtgccgtgctacttaagagaagggcttgggtttgccctaggttatggttatgctaagctcctcacaatttttataccacatccaatgacagcagacccattcaagcagaattggtttacaccatgagaaactataattcaaagaaagttagcaacttgctcctaggcatacccatattaaccaatattattcagtatatttatatacagcgcagagaacaacaattttaatggcattgtcagtattctttgatagataagcaccagttttgtgatatttaaaaagctattataggtgttgaggcttcgttttctcttccgctaaactgggatgaatctttctgaacagaacaaatacatatattctgtcctatctgggaaagattcaattatgtgttgcagtccaaatatgctgtattatatttacaggtaaaatcatactagcagaccagagtaaataactaggtaagttcctcttagtgacaataaaaagttatattgctcagatagtgctaatagaactttctgcaatagaaatgttctgtatctatcatgaccaatatagtagccaatagccatatgtgactattgagcccttaaaatgttactggtggggctgggcatggtggctcacacctgtaatcccagcactttgggaggctgaggggatgaattacctgaggtcaggagtttgagaccagcctggccagcatgatgaaaccccgtctctactaaaaatacaaaaattagccgggcgtggtggccagtgcctgtaatctcagctgcttgggaggctgaggcaggagaattgcttgagcctgggaggcagaggttgcagtgagcccagatcacaccactgccctccaggctgggcgacagagtgagtgagactctgtctcaaaaaaaaaaaaaaaaaaaaaagagtctcatgtataaatactgttttggacacacatcgttagaagacagtaaaggtgacactgtaaaaattttaaatcattaataactaattaccaccccaatgtaaatttcactgatcactgtcagtattaattctacagtaacatctgtatcaacaaatttccatatccctttcactggtattagggaggagatatcaaaagatggtaaacccagagcataaacttgtagatgtttggtaatgaaatgggactggacctatttgagattgtttcacaattttaaatcagggattggttatatagagctttctttcttgtattttttttctgcttctatgtggaaccatctagaatgcttgtgttattgctttaaggaaagtttttaaagggattcttaaaaaatacagtattttcctagcatatctctgaggtgataaaagtctaagaatcatagtttatgtgttttattcagatccagctcattctctcaactgttaaataagattcttgagaacaggtattattttttacattctggaggatccttatagcacatagaactatactgagaccaaactcgataatttcttataattttgattctgctggtaaaacacaaacttgatattgaaaatttgaatattctggacattataatttgcttatgaatcattctgtttgatattcccagataccctttgctaaggcagctcagaagggaaatatttgttcttgcagtttgtgtggttacgtggtttgttgtaaactttccctttgacctaaagaaatattgtccctttggccaggtgcggtggctcgcgcctataatcccagcactttgggaggctgaggcgagtaaatcgcttgaggccaggagttcgagaccagcctggcccacatggtgaaaccccatctctactaaaaatacaaacgattagccaggtgtggtggtgcatgcttgtaatcccagctacttgggaggctgaggcaggagaatctttgaatctgggaggcagaggttgcagtgagccaagatggtgccattgcactccagcctgggtgacaagagcaaaactctgtctcaaaaaaataaaaaaaaaaaaagtcgtctccaaaatatagcatggcttcaaacagatcgcattatctctctgaaacattttaacttatagatttaaaaatatatcttacagaaacattatttagaaacacaactttagtttacctacctctataaaatctccagagccagagtaaagattaaaatatgcattcacaaagagctttttaaatcatctctttattttacatctcccaaaaattctggaagaaggccgggcgcggtggctcacgccagtaatcccagcactttgggaggccaaggtgggtggatcacgaggtcaggagatcgagaccatcctggctaacatggtgaaaccccgtctctactaaaaatacaaaaagttagccgggcgtggtggcaggcgcctgtagacccagctactctggaggctgaggcaggagaatggcgtgagcccaagaggcggaggttgcagtgagccgagatcgcaccactgcactccagcctgggtgacagagcgagactccatctcaaaaaaaaaaaaaaaaaaaaaaaaaaaattctggaagaagtagtgtttgatttagcactcttaagggacaccatacatttgatgttgttaaaatagcttacaggtttatattagatttctattatctatcctgtcttcatttttggatatcatgtaaatatgttagataaataaattgagattgatttctaacaatttgtatgcattttgagatggcttagaaaacattcaatgcagaagttgatactgtgactcataccaagcatgctcctttgaatataagaagacaaaacttctgaaatgaggcaaatttaaaatatgacaggtttatattctggaggtagtgctaatagcccccaaagctactgatacatgagtttgtacactacagaaaagagaattaaaaagaaagtttgcacttcattgcagttccactcttgattattaatataaatcgaatgtaaattagtgaacttcctgtaaacacaacatgagcaatgactaatattgatagtctactcttaggttcccttgaaattgttctgcttgtctgataaaaccataacaagggacataaaaagattgttttaatatgttgagtgaattgtacatgaaaaattacattcccataaaaggctgatctatgaatgctaacatttatgttgttcgctatttctgtgtacttataccacccgtgtgagtgttgcttgatttggcagaagtaatggaattttaaaaagcagttgcatgagcaaatatatctattttccatatgtacatatttgcaatttagcaagtcatttgcttttgtttaaatattcaaaacgttgtcatatgtgtgttgtacacattaagattttatgtattttaaaaattatatatgtgtattgatatatttgtatgcacacagagcaaagcttgaaatagcaaaaggtaattacatgcatattgtatatactactttgtattaaaaatgtagtttattgatctttaaaaccaaatttgtttttgtaataaagagtaataaaaaattagattatgattttttcctttcaaatatgtttagaatttaaaaatcttggctacccctttaacctaaaatctgtcttacttacctcaaaatgcccttgatcccaactacatgaaatttcttgctctttcttttttttctttttttttttttttgagatggagtcttgctctgtcgccctgcctggagtgcaatggcacaatctcagctcactgcaacttccacctcccaggttcaagcgattctccctcctcagcctcccgagtagctgggattactggtgactgccacgatgcccagctaattttttgtatttttaggagagatggggtttcatcatgttggccaggctggtcttgaactcctgacctcaggtgatccacctgccatggactcccaaagtgctgggattacaggcgtgagccaccgcgcccggccttcttgctctttcttaaatatattatgtaattttatatagcacatgcatatttctgtgtctgggacacccttcctccctgtatctactccttgctatttcttctagcctaatttagatccctctttctatgtttctctggctcttttttcttaagatttgtcaagtcatgctgaaactattgccttgtctttctcaaaagactgtaagttcattgatggcagaacttaagtgtatattagtatctcccagaactcactcagggcctggcatagagtagcataaaagtcagtgttgttgaatgaatgaagaaatgaatagaatgataactgctttctacaggtgattgtgtgtaaacaaaaagtcatatgattaatccttctatgagcaaaagttggctaagattacaattaaatctgaatgtgaagattgtactgcagaaaaaaaaaacacacattttcaatagttatgtcacaaaagcaacccatcatgatacaagtagaatctgcgaacatttcttttaaggtgcgtataaactcatggcaaatttatgttgcattagtctttttgatgttctgaactttcataaaaaatcaacatagtatttaaaatctattgtaaaatatattgaagtttcattgattttattaaaatattaattcctttattttatatctatatataatataatcaaatctgaaaactcatcaagattatggcctagttgattacgtcttagttattatttgtacttttccatagccaacatgcaataaaagtttggttctagataattttttcctgttttacaccgtttcaatcaaaacatgttacaattgagtaaaacaatctgaaccagccttttataatacatgaattccaagattgtactaatttgtcagtttttgcttactgtctttcacaatgatttggagacataataaaatgtgcaaccaaattagtgaaaataaagaagtatatatataattgactagagccaaatatgtatgcagatttaaggcctgatgttttagttcactcattcaaattttaattaaaaacagtacataaaaggtgctagttgctggagtatgatgagaaaacaaaacagtaacaagacaaaaactgaaaacatgtttcctatccttgtgaaacttactgtcaatggggaagacgtacactcagtcagagaaatgttaatatttacaacgtaaagtaatatttacattatctgtattcagaaagagaatatcaaggaagcctattctgttggagtaaagagcttatgcaaagctcctattgtgggaaggaacagaaaggccagggtaactatatctaagaagaaaattacaggctgggcacagtggctcacgcctgtaatcccaacactttgggaggccgaggcgggtggatcacctgaggtcaggagttcgagaccagcctatccaacatagtgaaacttcatctctgctttaaatacaaaaaattagccggacgtggtggcgggcacctataatcctagctacttgggaggctgaggctggagaatcgcttgaacccaggaggtggaggttgcagtgagctgagatcgtgacactgcactccagcctgggcgacagagcaagactccatctcaaaaataaataaataaaataaaataaataaataaaaaagaaaattacggtgctacaagacgaggaggaactacacagaagcctcttcattcaagaaatgaaagctcctgagttcggatatctatcttaaaagcagtagtatgctattgaagaattgtaagcaaagggtgtcttgatcacattcatctgtcaaatagctctttattggtgaggttatgagaatgtattgaaagtaatgtaatcaaagcaaaagaggtcagttgcttggattaagggtgttggctaagaagataaataattgattcgtatgttattctgggacccctagaagccaaagaaaacggaaaataagaccaattataaaattcttattttcagagacaagaaatgccttcaggaaaagggaatttttttgtataattgtctactaaaagaaaatgttcacttatgactttagtgtatatagaccaatttatttagctttaaagtgaaattaatttcaggatatttggtagtaagttttagcaaaacctaaagaaaatagtaaagcacacatttctgttattgatacataatgatcagatatatttccatgataaatgtgatattataaagcacaacttttaaaaaacatttttctagagattatgccttaatttcagcctgtggaacatttctttaggagatattcatggctgctctgtgtccaactacatttgggagtcacctcatactgaatccttttatatactgggtcacttgcaaaggcttaattgagcatttgactgtcatatgccacagaatggatcggacactataaataaaacacaaaagagagtttgtcttttctgggcttcatcttcttaaaaaaatcagctattagacaagcatatgtaagtagtcaagaattatgataaattttctaaataaaaataagtgcatgagagagcgtaagagtatttatttaattcaggtttgggatcaggaaggtctcactgtggaatatttatctaaaatgtaaagggtgaaccaagaaaacagtgatgtggaagagcattagaaaatctggaagaaacacatgtagctgaagcaaagattatgcttattttgaagaaccttttagctgcagtaaataaaagacaccaaattacctccaattctgtaaagcagccttcatgactattcttcactttgttcacaatttattatctccagcccgtactaaatagataacatcatctcctacttcactgggggcttgaagggagaaaacagtgaactaaacttttacaagacattatttgtccagctggaaataaaaagtagaaaaaacatagaactttctatgtatagaggttataaagaccttaattgctttttaatttgtttagttcatgcatcctttgtcagtctgataaaagctgtgggactcctcagaaaaatacacagtgaatatcctttacatacaaccttttacataaaaatccagcagttcaaatgctcctgcaatccattcataagccattcataatccattcctaaaccagcttttggttaagtatccctgctttcaagtatcttgataaaatagtaaaaggaccagaagatacataaatataaatagaaaagtaaatagaagtgtgtgtctgctttactagaattttgaaatatcatgtttaaactataaattttaaatttagtttatggcttaagtacagatcatatattcccataaatgtgagtatatacatttatgtgcaaaccttcgctcacaaactcatatgcttagtgtttgagatttctcagtcctggactgagagttgggaaaaagttatgttttctttaacattctctcatagaaccaaaataataggagaatcagaaaaacataggcctttacattttggcttgagatcagcttctcgccatacctctagtacctcagacaaattacttaacatgtttgtacctatattttatctactttaaaatagaaaagaatacctaacacaaattgttcttatgaggataatatatgaacattgactgaaagatttaagctttttttacttaaaattatcctgttatagatagccttttctcaagaagtacataaaaataataatagtaaagctttgtgaccacaaaaagctacctacagtatatgtatgatgtttaacatatataacttgatatatataatatgacatatgcttgatatatataattagacatatgcttgtctaatagctgatttttttaagaagatgaagcccagaaaagacaaactctcttttgtgttttatttatagtgtccgatccattctgtggcatatgatagtcaaatgctcaattaagcctttgcaagtgacccagtatataaaaggattcagtaagaggtgactcccaaatgtagttggacacagagcagccatgagtatctcctaaagaaatgtatatatataatatcgagttatatataatatatatgttataatatagaatagaatattctataataatatagtatagaatagaataatattctatactatcatttaatatgaaactcacatagactatatttgtagctgtgggtaaatacatgtatgtaattttggtatatatacgtggcttatgagggtttttatggagacatgaatatggtgttaactaaattattataagtccaatgagctttgtgagatggccagtcgaagcaaacaaattccatgtatctccgaagccatttcctctagattgactgaaaaaaaatcaatttcctttaataaacatattttacaagctttgtagctatcacttacttcgtggttaaagtttacatctatggaagattacacagtaactttgtgctcacatgattgagtatcttaggggtttttatagatacatacttaaatatgtcagggaacttcatagttgtatgattggatgtactgggaacttcttgctccttctccttaatttgtgaaatcaagagacagagttactgcaaatttaaacttgagtaagtcctttgctctacttcatttttctcccgagaggcttctttttttttaaacgtccttttgtagaggcaaaatgtaaatattctctgaactctacttctgtatcttaccgtgaagaataataattagctcattaatttcaatttttgtaatatgcttaggtcaacaagattacttctaagggctcctcatcaaatacccctgtgtactttaggttcttttacttttagcaaggctgattcaaagttttttaattcataacttttttaaaaatttttccgagagtcacattgtatctcctttatactgacgtttattatcaggctgtttttttttgagatggtgtctcactatgatgcccaggctggcctggaactcctgggctcaagttattctcccacttcagtcccccaggtagctgggattataggcgtgagacacaattcctgggtttatcattttgtaaagctggagcaatcagttaagaatggagaagcaacagggccgcacggtggctcacgcctgtaatcctaacactttgggaggccgaggctggtggatcatgaggtcaagagatcgagaccatcctggccaacatggtgaaaccccgtctctactaaaaatagaaaaattagctgggtgtggtggtgcgtgcctgtagtcccagctacttgggaggctgaggcaggagaagtgcttaaacctgggaggcagaggttgcagtgagccgagatcgtgacactgcactccagcctgggtgacagagcaagactctgtctcaaaaaaaaaaaaaaaaaaatgaattgagtagcaatagatatcatgagcctcctcatggcgccaatattcgtttgaacccgccaacttcacatttagatatatgtgtctacgttgctggatgggccaggctatttgctcatctctcagttattttactatcctgtttcatctttttccataacactgttacactcacctttttgtgtcacttttaccagagccagtcattaatgaacaagaaatgtctttatttcatttcaaaaaagcaaaatatttctttgaaaattaaacagttaatttccaagccactcattaaagttattttattataagttttaatatcagaattataaaaatatttaatatgtcatctggtaattaatatttattcttttttttgagatggagtctcgctctgtcgcccaggctggagtgcagtggcgcgatgtcggctcactgcaagctccgcctcccgggtttacaccattctcctgcctcagcctcccgagtagctcttagcagcttcttaattaaagaatccatagctctctaatgcacatacgattgtgacatatttattcgttactttaagatcctcccccagtgttgaattctaccaattgcaaggtgcttccatggctttggacaaagtacagaagaattaaataacttcacagccttcatggaattcacagtaaggcagatcccatattaactcaattaaaatatatttagtcaaagccagatgcagtggctcacacctgtgatcccagaactttgggaggcggaggcggatggatcatttgaagtcaggagttcgacaccagcttgatcaacatggtgagacccctgtctctactaaaaatagaaaaattagctgcatgcctgtaatcacaactagtctggaggctgagacaggagaattgcttgaatcctccgggaggtaaaggttgcagtgagctgagatttcaccactgcactccagcctgagtgacagagactccatctcaaaaagcaataaaaataaaataaaatatattgagttgaatactgaaataggggtaactttgggaagctatgggccgcaaagcagagaatgatgcattcagtttgggggagctaagattagtttcgtaaaggaggtgacatcttgaagacatctagaatttcaatagacatagaaaaaattcatcgtaagcagagggactagtgaatataaagaagtcataaagatccaaaaagaactcagaaataatcaagaaggtgagggtagctacatcataattataagagccaactttattgagtacttcctttgtcaccatgtgctaagttctgtattttaatatcctcattgaatgcttgaaataatttctatgaagaaagatctgttttatctttattttactgggaggctgtgaaatatgcctaaggtcacacagctatcacatggcaaaaacaagattcaaacccccacagtttctaattttaaagcctcagcataatgaacacagtattgtactgaacagaatgaatgaatgtgagtagaaaagacatttctgagaacaaagctggaaatgtatcatacaaatcaaataaacatttcttgagaaatccttggggaagagggcaatataacctctcaaacagtagccagaatcatcaacacaaatatgtattttaagttctcacaattggtctcgccatatgaactaaatgctagatatttacttgcttaatgctaccaatgaattttcaaatctttccaaggtgttaataattttattgcttttttataccaagagcaagaatcaaatgttagttgctattgatgtttacattttaaataacaactttaatttagcctacaatatttagcaattacacaggaatcctctgaaagcttttaaccagccccagaagtaaactggctttggatgctaatctcttgagctttcctgactgacaagtttcctccctagaggaggggaattggcctgtctcctaaattttgcatggcctaaagcagtgagtttagaagcacctgtgtttcctggcaacaaacataacatttgtggaaaagtctaattatttaaattcctctgcatttttctaattgaggataaagtgctgcattctaccttcgcattcttattttattccttggccctttaaataaaaaaatacataaaatgatgtggtcagctaaaatatattggacaaacaaaacccccttcctttatctccctctatcgctctctatgtatatatattatatacatatataaaatatatataaacatatatatgaaaacagatatttgtgtgtatatatacactaagagatattatagtttaaatattttttaacatacactttaaaatctaacagcttggattttaatattgggtcagtctttctaaagtgtttaatattttagtttggaagtattaattagcaattcatgaatgagtaattaaaagtgctttagggggcctttcacatcctataataaataccaaaccttttaccacatttcatactataaaatcttggaaccccattatataactatgagttattaatttctgttacctacttttaaaatgggaacatatgttattaacaggtgttgctttgaaatctatattagcaaatgttctaccttataattagtttttgacttatcacaaaaaagtattttattttttttaattacatagtcacatttcaaggttaactttaaaaaattctaaattatctgattttcatgggaaagagatttgatatttgtgccttagcattttggtatttttctctttctgtatagcaaacctttgaatgatagtctgtctgaattcacagtgaagaaaatgatcagaatattgactgtcaacagataatttagaaggttcaatcctatgataatcagggatattttccttatgtaaatgtgttgatttatcaagttcagctatgtcattgattacatctaggcttcaggccttctgtgaactgccagctctactcaattctggcttgtgaatgttatcacatattttagtcaaatcagaggttatattatacacatctgacatttttctctttgtactaataactttttttctttttttgtttttacatcatggcataagatcaacactaaattttaggagtgcatagtaagtattaccatagtgtaatgctatgccaattgttttctaacttaatatttgcaaaactgggttttatggttgtttctatgcgaattgagtgcctctacagaattttatccctgagagtatatgagtggtgagtgataagagatactgaatgtctcagaacatactagcatctgacagcctattggtaagatagtgtaagtaaagaggataaggaaaatctgacttgaaaggagaataaaatctgattggacagtctgtagccaagtttgcatattatggatttacaaaatgaggttgttttgaattcttgattaatgaaacataaactgagttgttttaatattgcgtgccatttgaaataaaatgcattttgtcacaaccctagaaatgggaggttatgtgttgtaaaatattcttgttcccatctagaagacaccatattttatagagaacagtggctgaagcttgttttactaggaacaagtatggtgtaaggaaataacaataattaatactggtggcacttagtgctatagtaaaagtaaatttctaattagaaaataattaccataaaatactgaattatatctttgtaaggcctttagaaattgaatcactaatttaatatataagtaagtcaatattatttttatgagaaaatggacaacttacgaagttgttgttatgttttcaggccatattccatttttcaccaaacaagttatttccctgatacactcacttaaatcatcagtaatacatataggtttaaaaatgttttgtacaattctgaaagcctatcttagtttaatgaaacataataccataaagcttccctttcctccaacatttgagctacaataaaacaaccttgtacaactgataacaattaactcaccacccccaccccattgcagtcattagaattcattactaaaagctcatttgtttatggtaaaataaagtataagggttttgaaaccaccactgcaaaattaggactgagacagtgaaagagatctaacttaactgactccatcttgcttctaacctccactaatttatagtttatcgtttaaacaaacatcataacagccctttcccaaagcagaccttcttgcctggggactagattgcctctgtaggactaacatcagccacagtattagaaattatggtttaggagtcatgcagctggaggcaacaagattctgacccccaccaaactgctcctaagatcagtgcttgagataatttgcagaccctgcacttgatggatcagctggcactacccatatcaataaactggctcatctgatcttgtggcctccacccaggaactgactcagcgcaagaagacagctccaactccctgtgatttcatctctgaccagtcagcactcctggctcactggcttcccccgacccaccaagttatccttaaaaactctgttccccgaatgcctggggagaccgatttgctgatttgagtaataacaaaactccagtgtcccacacagccagctctgcatgaattactctttcttcattgcaattcccctgtcttgctgagtcagctctgtctaggcagtgggcaaggtgaaccccttgggtggttacaaatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataagggtaagaaattcttatcagtcaagtttctggtctctctctctctctctctctttctctgcattgttaaatagtaaactatttgtctcctctgcaagggtttggttaatagaaagaaggatttgtgagactaatcttagcacatctgatgtagtttgtgctaagaatttgtctttctgtgttatgtaatggagagagggatatcacgtgatagaacgtgggttaggacacccataagtctgcttttcaagtcagcttgggaggctggtcagctacaaactttgctacaggtccctgaaaccaatactctatgaaatttctctgtcttgttttgtgtccttaagagcttaaccttgtgaccatgtggggatactttcttttggtttctaccatccagaggacaggaattttggggttcatgtcatagttactcctaagatttttcttgagcagttaaaagccttgcaagcctgaaactggcttctctaggctccttctgggaaaagcagtagaaatttctcaacgctgtatatagctcagtagctaaggctttgtcttttgacagtggtggcctgggttcaattgttggcttctggaatgattcctttctgatttgttatttgtgtagctttgccatttattaagtttcttttctgatttcctctcttgaattttcctttctctggactaccttgtggagattctaaatcttgtaaaaagaaacttcttactatgtctttgcagcacctaggaggtttcctttggtaaagttcagaagctaaaaatattgtccacttggcatggctaaaattaggtaataagagatctaaaagaatttcttttttaaagagcactatggttaaaagtcagcttaattaagagtggataaacaagctatagatatatttaaaaggcctttatgtttttctcttcttggaacttgtttttttggaaaaagttttttcttctcagccgactgaattatttttctccatttttttctcttttttaatttttttgtcttgccactcttaacgcacacgtgagtccctaagataacttctggtagcctgggactcattgggaaaaacagaggaggcaccacagaacccgttttagggaaaaaaaaaaaaaactgttttccacatgaaaccccaggaattaaaaacagatggatccctctcaaaatcaaagactctgctctgtttttcattgtgttatctgatggttttgagttttggggatatcagaaattacttcacattatgagggagctttagtgtgtaataactagataggaaatatactttaagggatggctaatggtagttatacagggatacttgactctttgcacacttggatccagagaagcatgcttttggtcacccggaagataaggaaacattcctcaccctccactgggagatcagactcccatgaaggacgggctgattacaaaatgggctgattgactttgggttgccttgcaatgaaatgcagggtatggccgggtgccgtggctcgtgcttgtaatccaagcactttgggaggctgcactttgggaggccgaggagggcggatcacttgaggtcagcagtttgagaccagcctggccaacatggtgaaaccccgtctctaagaaaaatacaaaaattagccaggcgtggtggcacatgcctgtaatcccagctacttgagaggctaaggcaggagaatcccttgaacccaggaggcggaggttgcagtgagctgagatagcaccactgcactccagcctgggtgacagagcgagactccgtcttaaaaagaaagaaagaaacaaaaataagaaaagaaatgtagggtagaagcactgtactgtcttctcccgtagtatttctctccttttgggttgcagtataaaatggtgcccttaatttgggagttctgtctttgccttcagctgtgattaagccttagaaatgcatactttcctggccctgttcctccaaaggctccaccctgaagccagtaatctgattaagaaactggcaaataaaaagtcttatcagtgccaaatcttctgtctgtatttacatgtgtttttgtgtgtgtgtgtgtgtgtgtgtgtgtgtgtgtgatgtttataaaagagctctgattaattggcttggaaaataagtgcttaaataaaaaaatattttgtcagaaaaatagaaactttgatgactttttgttcacatgactttagtaatcttttggcaataaagacaattttaaagattattgttaaagtaaaatatcttgaaaatgtagacatttggtctaaattaaggtcagctatcagatttgctaaattctttaaggtcaaactgtttccttgactttggaaaattgttcaatttatttactttggagcattatattatagatgaggcctggggacacgtggagagctatgcccctagctatgctgaaaagagtcagaccttatcttcacttctgtctgatgtcctaggctccatccctagcatataattaaaatagcttttttatcaggtttttcactaaaaatcaaagttgctaagagttaacattgtaacatgaaatcgaggttactggagaaacagttttacatacaaggtgtgtagggaatgtgtttttggtgaaagataataaggcataggaatatggcttttgttgaagagaatgtaattttgtctagttcagaggttttaaagactgtcttaaactaaaagagtaacggaacgaaactgagggtttaagcaaagtgaaaagggtttatacagggttgatcctgaaaaaaaaaattctgtgggtataaacaagttggctaagatttgaaaaaggttatttagctttttctataggttaaaatattaaagtcatactgtggggccagaatctgggcccatgtgtccaaataacagggtcttcttagaaaattgatctgctgtttaatggaaaattataaagcgttctaaaaagtttatgagaatgtcaccttgtggtcaaactaattaaaactggatagatacataaaattttatttaaaaactagctttagcattaaagatgcactaatgcgaacatgaaatttggttttctcttttgaagacgatttttttgtaacgttaaaagataatgaaagggtttggctttctcctttgggtaaatggcaggggaaaaggggagagagaagagacaaattcagttatcctcatgctgtctttattgggtcttgtttggaaagctaagtctcctctgtcagaataaaggtttttcttttaagattttggagttatcgttttggtcaaatgaatgacttatggtgacctgggattctattttgtgatatccagtgttttaaacctttgatatttggcaaactttccaaaatcaaattataaattatgtctctttctggcctaatcttttagatattaggtcctctaaagtccaaaaatgacatttggcgtattttgcataaaaatcatacaggaaacattgtcaaatatgaaatggtgtttggctttttgggggctatatttgtgtaaatatatgattgacatatgttctgagattatgtaaaactcctataattctaatatgacttagtatatgttatcagtaataattgtaattatgttaaatggctatgtgccacagaggtaacaaatttccttgtcgattgtgtctttaactctggctactctacaatgtttgtgtcgtccacaggcaattgttgtctcatttttgtcctcttaaaagatggttttataggccgggcatggtggctcatgcctgtaatcccagcacgttaggaggccgaggtgggcagatcacctgaggtcgggagttcaagaccagcctgaccaacatggagaaaccccatctctactaaaaatacaaaatcattcctgtaatcccagctactcgggagaccgaggcaggagaatcgcttgaacctaggaggcggaggttgcggtgagccaagatcatgccattgcactccagcctgggcaacaagagagaaactctgtctcaaaaaaaaatggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtggtaagtaaagaatgtcactttctaacaggcccaggaaccccaagttatcttgggacctcaagaggagaggactttggtcaactcataggtatttgagggtacaaacccatggctgggctcggctttcaaaaagtcttatctgagattcttcatggaacagagttccatcaaagccaatttaaaaagcctaagtgaaaaataattattcttgctgcacttcatgcaaataatcaggccaagtacagtaagactaaaatgcattttataagcaaatcatttctatcatgatttgtttttaataaaaatggggactgaacagagaaatattatgcttcaaaagaaaatctatagtaaactattagctattcttgaggttaattcttcagtttagactaaattctaaattgtttgtgggttagaagttcccaaactaatgatttcaaatgtttgcttttaaaattgggaattgtacttctcatcctaggactcattataccttatagtaggctattcacataaacactgtagtaaaactatagatgagagtaataatgtttctgccacgcaagccttggaagcccaattaggcctgcatgaatccactcaaacagttgcaaagcagttccactcttctcaccttggagttcgttcccattcccgctacttcccccatcagcaggaagaagccagagcgatcgacggccttttcccatctttatagcctataccttagggttaaagtgttagaaaacccaaaggaagggattgaaaccacctttgcaaaattaggtctgagacagtgaaaacaatctaacttaactgactccatcttgcttctaacctccaagctgtcttcgttcattcctgggcataggctgaactaactttgggagaaacttagtttacagtttaaagatggtaacagccctttcccagagcaaaattccttcttgcctgggacttgcgtttgtaggactaacatcagccacagtgttagaaattatggtttaggagtcatgcagctggaggcaacaagattctgacccccaccaaactgctcctaagatcagtgcttgagatattttgcagaccctgcacttgatggatcagctggcaccacccagatcaataaactggctcatctgatcttgtggcctccacccaggaactgactcagcgcaagaagacagctccgactccctgtgatttcatctctgaccagtcagcactcctggctcactggcttccccccacccaccaagttatccttaaaaactctgctccccgaatgcttggggagactgatttgagtaataataaaacttcggtctcccgcacagctggctctgagggagttactctttctctattgcaattcccctgtcttgatgaatcggctctgtccaggcagcaggcgagttgaacctcttgggcggtcacagttttgacctagtaaagctttcattttcttgctttgccctatggcctaatttataatatacataaccaaaagccttagcttctagtaaatagtatttattaaagtgctatataaacgttacattttagggtaaccaacttttcttgttttatttttgtttgtttttgtttttcaggaatttctcagttttaaaatttaaagtcccatatcccacaaacctgcttagcccccaggcacaccagacactcgatcaccctaaagttctagtttattttgggatccttgcatcccttaaaattacatacaagatgttgggtatacatacatactgcaattgccatcaggttcaccttgcccactctctagacagagttgatttatcaagacagggaaattgcaatagagaaagagtaattcatgcagagcaggctgtatgggagactggagttttattattactcaaatcagtctccctgagcatttggggaccagggtttttaaggacaatttggtgggtggggagcagccagtggtcagaagtaatgattggttggatcagagatgaaatcatagggagtcaaagctgtcttgccctgagtcagttcctgagtggggggtcataggatgagatgagccagtttattgatctgtgtggtaccagttgatccatcgagtgcagggtctgcaaaacgtctcaagcactgatcttaggctttacaatggtgactttatgcccaggagcaatttggggagaagcagtatcttgtagtctctagctgcatgactactaaaccgtaatttctaatcttttggctattttgttagtcctacaaaggcagtctagtccccaggcaagaaggaggttggttttggggaagggttgtcattgcctttgttttaaaccataagctataaactaagttcctcccaaagttatttcagcttacccccaggaatgagcaaggacagcctggggcttagatgcaagagggagttggttacatcagatctctttcactatttcagttataattttgcaatggtggtttcaatacctgaatgcattttcgtaagacaaagcttcaatgccaaaacatctaagatatcccaatacggtattaattcatttgctcggtattaattcatttgctgttgctataaaacagaatacctgaaactaggttacttatttcaaaaaggaacttatttcttacagttatggaggctcagaatgtatctgcacaataggttcttctttcctgctgcccaggtagagctgatttatcaagacaagggaattgcaatggagagttttatacatgtacagccaccagctaagcagaagatcagagttttactattactcaaatcagtctcctcaagaagtctgaggctagggttttcaagatcggtttggggaaaggcatgtggaaagctacgcaataggtgcttgctgctgactggtagggattgcaatcataggactgtgggcaagggtcctcctgtgcactgagtctcttctgggcggggccacaggagcagttggcaggtgcaggtggagccatcagtcatcagacatgaaatatatctgaacagatatctcaaaaggccaatcttaagttctacaatagtgatgttgtctgcaagagtagttggggaagtcgcgtgtcttgtgacctctggaataatggctggcaatcctgtatgtctacaccgcagcagaatttagtttcccctatcctcctagcctggtggtctctcattagctctacaaacgcggttgagttttggggaagggctattgtcatttaaactataaatgtctcccaaagttagcttggcataagcccaggaataattaagagcagcttgaaggctaaaggcaagagaggagttggctagattagatccctttcacttccatcattttctcaccgttataatttttgcaaagaccatttcaagaagtcccaggtcaaaaggacacatctggtgagggccttcttgctggtgggaactctctacagggtcccaatggcctggggcatcacatggcaggagggctgtgtatgctaacttgctagctcaggtctctcttcttatcaagccaccagtgccattcccatgataatgcattaatccattaactcattaatccattagggcagaactttcatgatccaagtgcctcttaaaggcctcccctctcaatactgccacactgggggttaaattttggaggggataaatagtgaaaccatagcaaccactgaatcaaaggagttaaatgctatttttaaaaatgatgctaaaagacaaaaaaaaaaaatatagtgttaaaagaaaaacttgagccaaattaaagttaaaggagtttaattgagcaatgaacgatttgcgaatcaggcagccctcagaattacagcagattcagagagactccaggggtgccttgtggtcagaataaatttatagacaaaaaaaagtaaagtgacatgtagaaatcggaagtgagatgcagaaacagctggattggttacagctcgctgtttgccttatttgaacacagtttgaacaatcagcagtgtataactggctgaagaatggcggctgggattggccaagactgagtgattgtcacaggcccatactcctaagttagtttttcaatcttgtctacctattgagataggttgtagttcatccacagggactcaaatatagaagtacggagtccttctcaggccgtatttagtttgctttaacaatagactttatgggaaaatggtattttgttaaatgcaaaataataagttagagaaacactttagtgtttataatttttaatattgactgttagccttagctgtttatttatttatttatttatttatttatttatttatttatttgagacagagttttgctctcgttgtccaggatggagtgcggtgatgcgatctcggctcactgcaacctccgcctgccaggttcaagtgattctcctgcctcagcctctcgagtagctaggattacgggcacccgccaccaagcccggctaattttttgtgtttttagtagagacggggtttcaccacattggccaggctggtctcgaactcctgacctcaggtgacccacccacctcagcctcccaaagtgctgggattacaggcatgagccaccacgcccacctgccttagctgtttaatatgtaactcatggcttggtatagttcctgagatttggagaggcaaactgaggtttgaatcctgtcttcaaacttattggcagttgggcctgatcaagttgcttaacatttttgtgactcattctccttacatacaaagtggagaaattttgcctatttttaaatagaattgtacaggacagagaaaaatgtattttaagcctcttagtgctttgtgatatatagcaggcaatatttaaatggtaactattattattgataatagtaagtatgtatttatgtgcttcacagttttacaattaaacatgtccctctcagggtttcttactatattcttacctagagctgtgacatattaaaccaccttgcaccaaaactgaacaattggtatactgaggataaacattacttttttattcagtagatatcactggataattttgttataaatctctgacagtaaagtgaaagattatgtatatcagttaaaactgataaataacattaaaaagaaatttctgaattgaacatcttttgctctaaattttctggccaaatagggatacctcaaaggaaaatggccggtgaatttgtatacagataattaaatagtagttttagtcagtaaatcaggaggtccaaataataagtagaaccagggacatagcatgatggaaattatgctgcccagttttcaaaaacattgatggtaataaacagctgtgtaacataaaagctggtatgagaacttggtcaaattctttttacctgagttgagaaaaggtatcatctccccatattctactccaaactgatgaaatgctcaccgagctgctccgtagcctggctggttacctcactgaaatttcacccttggaggccttatgaccttttaacttattccacagctagattccaccattatccaaatcaatggtgcatttacaggtgattcagaagttatttagagaagattctgacatgttcaataaaaattccaaatttctcaggaattacttttagacatctctaaatgaataacagagaggttatgtgaaatccttgtgtaattatctgtgcccagatttttttgtcgttgtttgtttttggtttttgaaacagagtttcactcttatcgcccaggctggagtgcagtggtgcgatcgtggctcactgcaacctccatctcccaggttcaaatgattctcctacctcagcctcccgagtagctaggattacaggtgcctgcgaccacacctggctaatttttgtatttttagtagagaaggggtttcactatgctgaccaggctagtcttaaactcctgacctcaggtgatccgcctgccttggcctcccaaagtgctgggattacaggcgtgagccaccgcgctgggcctgtgaccagatttcttaaccatcacatgcctttggacttgccattcaatgttccatttagtagattttgatacattgaaaaatcactatgaacacattttcaagtctagctggcttcatttttgtcctctaaatggcactaaatagaatctgtgattgtgacagtgcctttgctttaatctaccagctatttttgaaagatatataacttaattgaaaaatagtacaatcttttcacttagaatctttacgaaaaatgtaaaagatgctttgccagtctgaatagttaattgagtttgactgtaccgggtaagatgcaaaagagtgtgtctatggcaactctttatctcataaaaaatttaaagggcctttatttaatgtgactccttttaaaattcatttaatggcgtaagtaaaactggatatataattagagtctaagataaaagcataataattgaaataagataatatgaagaagctcacacaacaatgattgggcttcaaatgaatatattctttaagctcagctgaactcttgtaagttgtattttttcactatgatgtaataataatggtatgtggatgacaattatactactttataaatgtaaggtgtcttatagtgtactaggatctttcctatgcattatcaaatctgaatctccaattagccctggatatttgtatatccttttttttttttttttttttaatcaggacagagtctcactctgttgcccaggctggagtgaagtggcgtgatctcagctcactgcaaccactgcctcccagatagctgggactacaggcatgtgccaccacacttggctaatttttgtatttttagtggaaacggggtttcaccatgttggccaggcttgttttgaactcctggcctcaagtcatctgccacctcggcctcccaaagtgctgggattacaggtgtgagccaccaagtccggcctgtatgtccattttttagaaaaggaaactgagcacaaagaggttgagtaacttgttcaagatcacataattagtaagtgataaagtcacactcaaacccaggtattctaacttcaagtataatgttcttttctctgtgttccttctttgtataatagagagcaatgagtatgtaggaagggcagaatagctgcacagatctttacaatatgtctcacaataatgctgtgctttcaaaagacttgatttaatcattttgtttcctcattcactggtctattcattcaggctaagggggcccttttttctagatagatttgctttcaccatttcattcccttgtcaatattcgccatcttagaataattgtgttttcattctcccgcttgaaaaaagatgcttaggtaattctttatttaagaagtaaagaaacattatcaatattgatatagatatgaacatatatatatatatatatatatatatatatatatatagagagagagagagagagagagagagagagagagatggatagatacagatatagatacctcaaatccaggaagaaggaactagattttttaattatacaaaaataaaatactcttttttaatttttttcttttaccttttgtgttctttacataagatcaaatgaataaatacatttatttaataaggaagcttattggtagttcctgtagtatttactgtctattaagcatcaacctaggaattgtaccataacttttgtttaaatacaattcttctattgatgcagtaagagctgtcagtcatagtgctgggaatgccagaggggaagtcatccctgacaacattttttattgcactattaatacgtacaagttgacgttcaagtgtgtgtatgtatgtgtgcgtgtacataggcacacagaaacatcatatatacatgtgactacgtaaaaaaatacacttaaacatatctgtttactctgtaagtgaataatcatttatttcaatgtttagatgagattttaacatattagaatggcttcatttttctttctaggcaatctgctagcaggctttttccagcaacctattcttcccccatctttttgatattataccaagatttctgcctccatttttgttgatgtaattatcccggcataattttgaaaaaagatttcctggcaatgtaaatccacaagattgttgatatggcttgagctcaaatgatgcttctatccgatttgtttacctttcagcttgagcagagttcttgtttcataagaaaaacaggaagagatactatagtagagaaggacttttatggatggttttattttaagtaaatattgcctgtaagggatccaggaattttagtgtttttcttggattccttaaccataatacttagcccagagcaaaactttctctcaaatgatggtaaaaaatctaattctattaaatcctgattattctgtgagctaccttggaatacattgcctatgagtttttctgctaagaaatggacttcgtttattgctcattttcccaaaatcaaggaatgctgttgttcttcaatttagatagatgttgacaaggtcctcttcatagcagcaggtgttaggctataattgctcattatagaattatgttttgcttgaaggaactcaggaaacaagaaaagcatgttttctgtgtatatgaattctggttgaaaaattgaaagaatgacactaggaatagtatgtaaattggcagaatttgtcatttcattgtgcaactagtattttaaaaggcaataaatcaacgtgaacatccttgggaaatcagtctccttcttaggcctaacttgcaaagtacccccttaccattgtatttttttaagatagaaattgagattagagcaacacggggagcaaaatattggcagatgaacttgttgaaggagatgaaaaacaagaagctatagaaatagattggccaatagtgctgagcaactactcaactgcaaaaatggcttgcttttccaagcaatgtgtaaagcaattagcaccaacgtttttattagtttacataaaataatattactttgtaaacacctataaacagagattacctagatagcctaagactattattaagtacaataaaacgttactggtttaaagtaataggtatagaactttgtattgtatggtgcacattcacataactagagaggaaatggaggtctacaagtcaaggttgaattacacacttgtaatccatccttaagggaaaaagcttcactgatcaagatggtactttgcacaaccttgccaattgtttcacaaagctgtaatgatgccacaaataatctttcacctcccatacctaagtaaaccatatttgagttattttctctgctccttcctatacctttcctctttggcatcacaaagtcagatttttaacctacaggttgacataagccaaaaatgttggaagattataaactgcctctctttctctcactgtatgtgttgtgtatatgtgtgtgtacacatatataagcacacacatagatagaactcacacggaaacataagcacatatctacgcactgttgttttgctaccatatccagtgataacgtttattttgaattacatgtattttttttctgaatttaagagtgaaatgaaatagagttttgttagatatacagttattacctatataaaaatgattctgtgcatacttccttggcaaagtacaatacctcctccgctgtcactgccaatgcacaggtgttctttctcctggctgttagactcactgggagaacttagaaaaatatttcagccacagctttactctagcctagatcaattaatcactaccttggccttacaatctactaggcagtccttcccaaactctagaatacagcagaatcccctagaatgcttattaaaaatgcagattctaaagccccattctaaatgatattcttctggtaggtctttacaagtcatgtattcctggggtctttctttgagaaacacaactctaaaaggtctttgttattcccattctgggttttgaattctttctcgaaattgtaacaaaatatatgtactgaaatactgttcctctaacaatctgaagaaattttcagcactagcagcacttgttggcactattgttgttattttgtttaatatttaagacaactaaaagttacagtaatttataatgagaatcagtattatggaatcaaccattaacagttcatctcactaaagaatttttatttttattatttatttatttacttacttatttttgagacagagtctggctctgtcgcccaggctggagtgcagtggtgtgatctcggctcactgcaacctccacctctcgggttcaagcgattctcttgcctcagcttcccaagtagctgggattacagctgcccgtcaccacacccggataatttttttttgtatttttagtagagatgggatttcaccatgttggccaggctagtctggaactcctgatctcaggtgatccacccgccttggcctcccaaagtgctgggattacaggcgtgagccaccgctcctggcctcgctaaagaattaacatcatatgttcactagtactgaggttagttcccaaacactgcactaaaaaaatgaatgaaacaaatgaatgaaaatgtgtttccttagccatattctaagaaaatcacctctttgattattgtaattggaaccatctcttctttctttgcctggaatctttgtaacaaggttatcttctttcatgtcccattccaattagtaatcatttatttctattaaggcttttataatcattcggagaatccacactctttgtgtctgcagtcgctgagttcactcattaaatacagaattttcaacaaccctatttccatcttcattgttattaatacttcaaatttgcttctgttcagaaccacgcacttgtaggatcgagtaggtatacgtgttatccgtacacactctgaaaaactccctgcagacacttactgaacaggaattgcttatttaactgtgttttctgtctctttcatacatgttctctctctactgaagtgattgaaggatgacaaaggtccttatgggtgtttgatggcctgtgaatagctgtcggtctacgaattccctgaaaataatttctccacttgtatgaaaataatttactccgtgacttttcatgttgtattgtcaatcttccttctggttgtatcaggcaggagtcattgttttacatttcattctttagggggcctatgcttggatttctcccattgagaaaaaacaaagcataactctgacataatcgttggtgttaatatcatgaaaacctggaaaaactaaaggcaaggcaaaaaatatgcattcttatgcatgctttatgtgcactatgcccgtacataaacctggcagaactttaggcagaattaaaggtttaaatgggcatcatctatcctctataggccttttagtgtgcttcttatgtcctgaggaccataagaagatctaggagctgagtcctacctaccccacattgctggtaccgttgggggctctatgccattctactccagccagcttcctaagattagtctattacttttgtttcctttttttcttttctttttccttccttccttcctttttttttttttttttgacagagtctcactgttttgtccaggctggagtgcagtggtgtgatctcgtctcactgcaacctctgcctcccaggttcaagcgattctcatgcctcaccctcctgagtagctgggattacaggcgcgcaccaccaggcctggctaatttttattttagtagagacgcggtttcatcacattggccaggttggttttgaactcctgacctcaagtgatctgcccgcctcggcctcccaaagtgctaggattataggcatgagccactgcacctggccttattactctcgtttcctagacattattccacccttcctaatacttagctacctacttttgcttccgtttaaccctctgtaacttgttttaaggtggttttttttttttttaaatcctttggctatgtatgttcttataaagcaaaatttagttgtgtcaattcatgaaatcatattagcattcacttagaggagagtgagaaatgtttcctgctcatctatatagcattgcccatttgcacttagttttgatatttgaggcaaatccttcggttttattgtctaaacacacagttgtaattctaaggaattttacaccaggtcgaaggaggtagcattgcccttgcatactattatgtagggcattgtaatatgacatctgtcatatagtgagatgaggatggctacctctttcacttaaaatagctctggccctttatataaccaaagaaaatataactgaaatgcttggcaagaagtaaagttatgaacaatgggcttccagcatttgctgtatgcctgctggcataggaattccaagcatataatgggtgttctttatataatgaaaagccaattgtgagaccggcttataatctttggtgccagtaggcagcatgtacatttcataatttcatcctaatgttttaagtgatacaaaaatgtcctttttatctactaaagtgcttcacatgttaataaatacatgtaaatttctgtaaagtgatattgtcccttaatgaatcaaactgataattgtttctatctcattaaaagtaatctatatttgaaagtgaagaactctacaaataaaaatatttaacatatcaaacatttgaaatttctaggtattgtaagcacaaatatttatggtcatatttggccagaatgttttccttgtaaatagacttggaatttttatatccactattgtgattggctgtaataatttttcaagtactgtatacacaaaattataattacattttatactaactatgggtgggggctgtcaagtgtaggtaaacaccaatttgcctcatcatctcttttgtaaaacctccaaccaccaaacctaatcgagcaagtttatgcctcctctactgcatgttagcactttttccatgttaatgtaatatttgtacacaaacctgtatcatccaacagagcttctgagaagtagagacctttgcttattagactttcagttcttacttcgtagaatggtggttggccattccatacattttattttattttattttattattatttttttctgagatgaagtctctctctgaccccgaggctgaagtgcagtggcgcgatcttggctcactgcaacctccgcctctgaagttcaagcaattctcccacctcagtctcccaagtagctgggactacaggcacttgccaccatgcccggctaatttttgtgtttttagtagagatggggttttgccatgttggccagactggtcttgaactcctgacttcaggtgatccacccacctcagcctcccaaagtgttgggattacaggcatgagccaccgcgtctggccatcaatgcattttaaataaatgaactaaataatgaatatcatttaagtgcaattctgtttacatttgtttacatctatacttattttaatcaagtatattcggtggtgtcaacaatctgtagcttaacaattttaattgaaagactctaattacatatcactatataatagttaaatagttttcttggatgaaacaaaagagagtgagatagagaaagaagtaacaattaaaggatttcattatgtgatagtcttcctgtgtttttttttccttttagaaagttgccgcaataatagaaaatgtttatttctttttcttactagtagaggtggcatttttgctatagagtgagtgcccttagttcttcatttattaacaaatatttcattctatgtataaaaagtataataaaatcatatagacaatgttacatgaaaaatgaacggattgttattacaccaggaaatcactactgtgccctatcaaaatgagtttgaagtatatatgtgcatatatatgtatatatgggcatgaatctaaggcaatcaattatgtctattttcaatgctctgtgaagaaagaaattggttgcctactgtcacattttatcttagtgatactctttcattaaaatgcacacacgaaaaaattaaaaatgtaaaatctgattttctaagtggacttaggaaggtacagggaacaagtgctagtgcgtgaagtggaaagtatgagagtacatgaagttgaaaatgtgtttgtgtgtgtgtgtattgtagcaggtcatctaggactgcaattttcaaccatatgcccaagccccggcatagagatagtgattcagttggtctggggtggggtatgggcttaggtaatattttatggctctctaggtggttctgatgtgtagtaggggcaaagaactgcctctatgggtgtctaggactgtactgtaactatcagcaattagtgagagggttctttgtaatgcctttgattattcttctagagacatatgttctgtacatcagccggggagcaaaaccagggaattccagaagtggttctcccttaagacttactctgacggtgttagtgttttcataactcgagccttaccctcattctaggaaaaattataattattatctatcttactttccaccctcagtacttaacattttaagggatttagtgaatttttccacttccctttttatatttgttgcaggtaagtcctgttgaatatcatcctcaaatacatgcatattttactgccatggtaacattttctactttttcttctatttttttcatatgtaaattatcattgaaaatttggcagagtctctggtaaccaaagtaatcttgtctgtttctgtgctactagttttattataatttgattcctgttccaaaaatgaagtacagtaataataattttttaaaactcaaattatttgtaggtcaatattaatgactttttattaatgtatatgtatataggtttaacaataagtgaagcagcttataacagtatatattctattaagtagaaatttacacataaagttagaagaactccatgtgcagtgtcctcttatgctcatatataactttctgtttcaaataagagtttcaaaactagagtctgtgtggcacagatggtgaattgatgccataatttccaatctgcttgttagtagagatatgtcatatgtttattgatgattgcaagtatgtttggtgcattaaagcttcatatttagtattataaaaaacttaatgtcatgtggggaaagaagttgctacctttctaaaaattgtagaatagccaggctcaatggcgcacgcctgttatcccagcactttgggaggccgaggcgggtggatcaccggaggccaggagttcaagaccagcctggccaacgtggtgaaaccccatctctactaaaaatacaaaaaccagccaggcgtagtggcgcacgcctgtgatcccagctactcgggaggctgaggcaggagaattgcttgaactcgggaggtggaggttgcagtgagccaagatcacaccactgcactccagcctgggcaacagaacgagactccatctttcaaaaataaatagataaataaataaaaacaaaaattgtagaataaactccttgaattccaggaagaaacaaatattgttgtccagttatgcaattatgcataatgagagttaaatgcacaaagtgatcttaaatgtacatattcaaaaatagaggttggatcaagaattcagattattcaatatcaattcaattccttctgttgtgccatttgaatcctattgccaaagatgattattcatcttgaaaaacagactcccaaattcagagttcctgcattttaatttgcccttatgaaaggaaggattctttccttttctggaatacaatcaacttctgctgagaagaaggaaagtctttattcaatactgaaaatgtgtattttcttaccgtctatttatatggacaataatcaaacttttaattatcttctcacaatacttacagatctatgagaagagttgctatctaaagctggatctttatggagaagagacatgctcaagtgtagcgaataatttttgttacatatcagtattaactaagctttgcaaagtgaatagggaaacttatatttaaaatgtcagggaaaaaaagagttttaagtaaaagggacacctggaactctaaagagactatagctctaaacctgtagctgaattctgccttagatttcgttgacccttaactaggggcaaatgcacaccccattctcagggtttcccacacacctctggaaggaacacaggagcgtatttacagctatcgtctaaccattatagaattcctggggacaaagttgtgtcagccacctttgatttgtagtaaacaggtacaaaaccgcatcatggaattatttctgcttatataatcctcttctgcagtgtctgaatcttggcacctcctctccttcctcctaaccactgcaaaaacaacacccagattaaggcatcggggagaactgaatatctgaatatcaagtactccatatatattgatccatcgaatatgcctacaatatcactactaacctacaagtgtaccaggagttacacctgcagtataacagattaaaacagccttctccaaagctcatcactttgaatgttaaaagattcattttccaccacttaaaatctgcatactatgatctgtgtataaaaagctaaaagatatatccaatttcaaatgtaatgtcatgcaagtgtctactgaatgtgtatatatctttgtaagtgtccctgagcaaaataactttcaacttaacattctttttctcttggatataaaagagaataacgtaacaagagcaaatttgcttttaaatttctgccttgatagcaagttaaagtatttagaaccaacatcctcttaaatgtataatttatataacggatgagtctagaacagcatttccaaatggaaattgtaaagaacattgatcccgtaagatgttgaatgaaaaacaaattgttaaaatgtgataatttcatttccttctttagcgagtcacaactcaaccctgaaatgttttgtagttaaaaaaattgtttaacttagtttaacccaatgtttctgaacctacgtcacaaaggaaatgtttttgtcaagtgatacataactttcaaagagattggatttttttttttttttttttgaaatgaagtttcactcttattgcccaggctggaatgcagtggcatgatcttggctcactgcaacctctgcctcccaggttcaagcgattctcctgcttcagcctcccggttagctgggattacaagtgcatgccaccacgcccggctaattttttttgtatttttagtagagaaaggggtttcactatgttggtcaggctggtctcgaactctagacctcaggtgatccacctgcctctgcctcctaaagtgcagcgattacaggcgtgagccaccacgcctggtcgagactggaattttttgaaacacattttcataaatgaattactggggtactctctgtttattaactatgttagtactgacaaagattatttgctcggccaaaatttattcaggcttcccaaccttctcatagcccagtctgtgcacattctcctaaaatttagttttagcaggccagatcagtttagccagaaaacactcatccttggtatttgattatcctggatatctgatcatgttcctcatcatccaccatcctccaggggatgactggactattttcagcaggagtctcccttacccatgatgcttcctcttaataattttccatccactgacccctaccctgttccttggttataaaattcccatttgcctgtgctgtattcaaattgagctcaatctctctcccctactgcaagaccctattttcacggtccctatacctattgagatggtcttgaataaagcctgccttaccgtgattcagcaagtgacattgaataattttttctttaacagtataaggatcgcacattaccatttgttttgaaagatggtataaaaagactaactgaaaactaatcttggctgggtatcactggcagaaattcttggtcttcaatctatgtagaacagatatttgcattttcttttgaaaatttaatacattgattaaattgtcattttgttataaaaatatgaaatgaagggtacatatgatttttaaaaatttctgtccaccatcaccaaccactatgtgaaaatacacctttgtaagactttttctattctataacataccttcaaaaccaagaagaagtatttgtaggaaattcattgcttttatttgtgaattgataaagggaaaataataagctagggctcgagcttcagaacagggtgatggttttatatctctctcaaaagtactgcaaggtaggttgtttcaatactattaacaaccccagggttccctgacatcttctattcccagcttccattctcaaaaattatatcgaggccatgagttggactcctcagccctagcaaaagattattcatttgctctgtaacccttcttgaaccccttttcctggtagctgtgcccaataaatccgacttatatatctttgggagttggagagagagagagagagagagaaagaaagtgagacagagagagatagagggaaattattttagctaagaaaatttacagtcacaataatatgagagtctctgaataagggataaaagaatattagacgagacatagtctctgccaatggtgattaagtaaacatagtcaaggagaatatggctgtgaccattagtgtgtaagtggttacatctggtgggcaatctccagtcataagtaaaataatctacgagtgagatacaggctaagcaaagatttcataattaggaccgaacaagcactaagtacaaagtcaaacactgataaattgagcttcattaaaactaagaattctatctattataatacactaataacagtgaaaagaaaagtcatggactgggagaaaaatattcacaagacgtatatctgattagaaaacttgtatccataatatataataaactcatacatatcaataaaaagacaacccattttttaaaagttggcaaaatatttgaacaggcacttcataaaagaggacaaagatggtaaaaaacatttgaataggtgcctaacttcattagtaatcaaagaattttgaatacccctatatatgcatccgaatggttaaaatataataagacaatatcaagtattggggagaattggtgcctcagctggagctctcaaatattgctggtttaagtgtaaattaatatttgccaatatctactaaatctaaatttatgccttccttatgagccagcaattcctctcatatgtatgtgttcaaaagaaattagtaggccaggtgtagtggatcatgcctgtaatcccagcactttgggaggccaaagtgggagggtcacttgaagccaggagttttagactatcctgggcaacatagtttgacctcatctctacaaaaaaaaaaaataaaataataataatcaaaattagcctgacatggtggcatgcacctgtagtcccagctactccagaggctgagatgagagaatggcttgagcccaggaagttgaggctgcagggagccgtgattgcaccactacactcctgcctgggacagagtcagaccctgtctcaaaaaaggggagaaattaagtccaccaaaatagcatgcacaaggtagttaatagcaacattttgcataatagcagaacctgatataacttgtgtccctcagaattagaattaaaaatgcggtatagactgggcgaggtggctcacgcctgtaatcctagcactttgggaggcccaggagggcggatcacttgagatcaggagtcagagaccagcctggtcaacatagtgaaaccctgtctctactaaaaatacaaaaaattagccgtgtgtggtggcaggcgcctgtaatcccagctactcaggaggctaaggcaggagaatcgcttgaacccaggaggcagaggttgtagtgagctgagatcatgccactgcacttcagcctgggtgacagagcgagactttgtctcaaaaacaaaaacaaaaaacaaacaaaaaacaaaaattgggtatatccgtggaatattatatagtaataaaaacctgctacttggaagaatatgaacgaacttcataaacacaatgttgactagaagatgaacatttactgtgtgattccatctatatgaagtttgagaactggccaaagttatctataatgattcaggtcagcagagcagtttcttcctgagaggctggtgggaatatagtgtgaattgggaaagagcatgaaggagacttacagggtgctgcaattgttcagaactctttttccttgatacttgcttacagaaatgtgcagaatttttatttcacctagttttctatgcatgcgtagaatctccatagaacacacattttattaagtacgcattcaacttcttctaaaatacctctagtcatagaaaatgtaactttatttctttattccttactttgcctagcccaagctcctacaaaaaaaaagattagttaccatttaattcaaattataaaacagaaccagtcttttaaacagtatcggatacacaagtatctaatctaacttccattgcctatcagtggatgtggctttaatcaagtcttttctaaacaagatggacaggcactgaagaaaaaaaaagtgagccattttatgtgttttaaaatgataatgtgattttgaattttgctattgtagaagctcctaacaatattatctggcatttgttctatctgaataaagccatggcttatattatgtatatatggaatttcccagaatactattgttagacacatcactgagctgtgaaaaaaaaaatcatctctaatttgatcaatatgtacttacacgtatatcattagttgccattgctctcagcctttagtacattttttatgagccccgtgggccatgagcttgctttttcataacagagaacgagaaagaagaaatctcatcagtataataatacccacatcagtagagggcatggttcagaggcaatcttgttgtctgtcacagactccatgatataagctagaaatgataaagagattcgttacaggatactgtaaaagggatattatggtatataaactcattaagtgttaactagatcaaagcaaatatggcagaaaagagtctctgaatactgtagcagagtttattgaatgaatgaacgaacgaatgaatgaatgaatttataaaaagcgcaggggggccggggcgcggtggctcacacctgtaatcccagcactttgggaggctgaggcagacggatcatctgaggtcaggagttagagaccagcctggcaaacatggtaaaaccccgtctctactaaaaatacaaaaaattagccgggcatggtggcgcatgcctgtagtcccagctacttgggaggctgaggcaggagaatcgcttgaaccctggagacagtggttgcagtgagccgagatcgtgccactacactccagcctgggcaaagagagcaaaactccgtctcgaaaagaaaagaaaaaagaaaagaaaaagaaaaaaaaaagagcgcaggggtcagataattgagttagaaggtagaggagtggggatgttaatgcccatgtgagaaaagaggaagaggtattgaaggaatccagcggactttgatgaggaccatgcgggactttctattttcaggaacctaagggaacatcttgctgtaggcagcctggggctgtctccatcaaagaaatgctaatatttacattcattggtttttgttatgtgactgtctatgtgctaaagctgtggttctcaaagtatgtttcagacccgcaatatcacctggaaatttgtaagaaatgtaaattctcgggctgtgcggagacctactagataatgaattctgggagaggtattataagaagttcttcaggggattttgatatagtctctaggttgagagacagtgtagtagacaatacattcattactttatttattcttctccatgattctataaaagagctattgttactgctttgtttacaaatgagaaaactgaggctttgaaagaggctcagtattttgttcaaggtcatatagctggtatccagagatactgggaatagaacccaaatttgtcagactataaaacacggtgctttcagccactcctccagagccagggggataaaaattcattaatttccatgagtatttgtaatagtagcccgcaagtcctggaatacaattataactgctacagcattacctttgaggagaaaatatctcatttccccaattgattgccaaaataaaatgcttaaaatacaaatgtctggttgaagaaaccctttaattttttttcttgcgttcaggcatttgtgtcaggtttaactaatttattttaacttgcaatacagtgttgcctgtagtaacaaataggacattctgctattagtttttaatctcctaccgacttgttattttccactcctgaagctaaacttctttaacaatttctatgctcattgtatctacttccttactcacgtagctacctcaaacaccaataatccggctgcttccacatccttcaactgaaattgattttgtcacggcccaagtcacatcaggcctcatcttaccactctgtagtattgattgttgatcggtccttcctattggaaaaactcttcttccctggcttctaagatattccactattctagttttcctgtctcagggcaactttatcattttcttggagggttgctctcctatcgtaaatctcttttaacgttgagcttcaatcttaatgctcaatcaacatatttttcttgatctcatcaaaatccatagcaataacaactcttaaccatgaccctcagatttttatatccaaccaaaatcattcttttgagctagagacctatccccctgcccatcagttatgctcatgtatgtcacatagttaattcaaaatcagtatatatgagatcaaaaactgccttctaagcaattcttcctccttctctagctcattgaaagacatcatgtgccaaacttctcaggtttgggggtatcattcttgcattctccctcgagatcactgttctaacattaccttggcatcagccatcatgttttgccaggattgttgcagttcccctaaaacagatgttcaatttcccccacccctgtgattcagttttccacatgcagccagaatgttttaaaaagcatattcgattgtgtcatcttccccctagaaaaccttctgcggtttcttcaaaataaatttaactgaataactagttgacttaattcaatgttttccttcgtcacactaattaatcagtattttcatggtcctcgatgctgagggcttaacattcaagaataaatttgtcttatgtttactttaacttataaacttcctttaaatgaaaactaattgttaaatgatttgcaaaataaccagaggcacaaagtctattgtgatcagtggatatgacagaatatattttttgttgttataccatcactttcacaaaactatggaatatatatataggcatataggtgtgtatgtatatatatgtatagatatgtgtatagagacataatttatagaaacattcgtaataaacccctgccaaacatattttgcacgtttgaaatattagttgattggatttgtggtttgtatgtaagttgaacaattaactgatgtgatcattctgtttccatggctgttaccttagtttataccaccttttcacctgagtgattacaatagcctcctgattccttgtctctttatttgccacgttcccttcttcaaacttcccaaatccactttcccaattgttatcaaaaagagttttcctaaaatgtaagtcagataatgctactcattatgccaaattctcattgccccaaaagtgaaatctgaattctataagatgctctaccaatctctccattaattggcctctgcactatctctttacattcaccccttcccacccaccgaacccacccatccctcaagaacgacattgtacgtactaatcatgtcatacaagtcactattctagcttctgttattcttctggaaatgtcatctcccacctcaactttttacccagctaactccagtttatcatttaggtgatgtctcctttttggaacatacctagaattgacgttacaggaggaatatctcttgtgtgtcatctcaacatcccacagtaactatttttttttctttttgttttctttctttcttttctttttttgagatggagtcttgctctgtcacccaggctggagtgcagtggtgtgatctcggctcactgcaacctccgcctcccgagttcaagcgattcttctgtctcagcctcccgagtagctgggactacaggtgcgtgccaccatgcccggctaatttttgtatttttttagtagagacggagtttcaccatattggccaggctggtctcgaactcctgacctcgtgatccgcccgcctcagcctcccaaagttatgggattacaggcatgagccaccgcgcccggcccacagtaactatgttttaacatacatcaaaccactttgcaatttcctgtttacatgtcattatccctcattagtaagcttctaaaaagtatgggcatttatccagttccctatcatctccctagtccccagcacaatgcctgacacttaagtaattacgtgagtaattaaatgagtaattatgacacattcaagcttgttaaactctaaaacttggaaataaggcaaaagaacaagtagatgttcttttattatcatactaaaaagtattgtctaaaagatctaccgacagatagtttaatttgttagggacatgcgtctttgtataacttagtactaacttaaaagataatttttttgtgggtacatagtaggtgcatataatttggaagcacatgagatattttgatacagacatacaatgcatagttatcacatcagaataaatggggcatctattaccttaagcatttatcctttgtgttacaaacaatccagttatactcttagttatttaaaaatgtacaagtaagttattattgactatagtcaccctatagtatttactattgattagggcttagattctgagaaattttacataaatgtacacatttttgttcagtagagagacaagtaatatctttctggcaccctcaaaatatataattttattgcactttttgatgttaatctgttttgtttctaacttagcaatcttgttctagcttctttttctttctgtgactatgtgtgttcagtcccttgaattcccctttgaatcagttttaatttgttgcctgttttgttattagttagttgaataaatgtttccatattatcaggatatgtttataagggaacagcaaatttacttccgtgtgttttaaactatatgagaaacactgagcttggcatcaatagctaattctaggggagaaaaaaagtcattctcgtatatatttggaaaaacagtttttattcctttttgagatattaacagccatttgtatgttgaagattctgagaaacttggaggtgatttaatctgttttgctttgtttaatctaaaatttcaagattattttggttctaggaaattttgctctagaaaaaacagtttggaaacattggtttacttatagctttaaagaacaatattttaaactacaattcttgtgttcgaaatgctgtaaaaatcatttctattaagatttatttcctctaagtgttttgcattcaaataaggtgaaattctgggtctccaaatatacatttcagaaaagtctttgtttagctgtagggaaggcatcctgacttctcatcattatagtcacatagatacactagatttaaaggatatttaggtcgggcgcggtgactcacacttgtaatcccagcactttgggaggccgaggcgggcagatcacctgaggtcaggagttcgagactggcctggccaacatggtaaaaccccgtctctactaaaaatacaaaaattagctgggcgtggtggcacttgcctgtagtcccaacttcttgggaggctgaggcaggagagttgcttgaacccaggaagcggaggttgcagtgagttgagatcgtgccactgaacttccagcctggggaacagagccggtctccgtctcaaaaaaaaaaaaaaaaaaatagagcgtaattatatattttccttattttaaaagggaaaaaatactttccttattttccatatagagtatatcaaaataattacaatcattaagtaaaactaacatttacctgtggtctaaaaaagtcggttgaggccaggcgcaggggctcactcctgtaatcccagcacttcgggagttagaggccagtggatcacttgaagacaggagtttgagaccagcctagccaacgtgatgaaaccccttctctactaaaaatacaacaattagccaggcgtggtggtgggtgcctctaatcccagctacttaggaggctgaggcagaagaatcgcttggacccaggaggaggaggttgcagtgagccgagattgaaacactgcactccagcctgggcgatagagggagattcagtctcaaaaaaaaaaaaaaaaagaaaagtcagttgagatagtgaagatccaaagatatctgctaaaaaagtgtgtgttatctagttttaaaaagaaatgatatgcaaataaaaacattagtgagcagttaaatatttaaagggtacgttacttacattatgggtgtaaagtgtaagtggatttctgaaaacatgagcaccatgtgaacttcagtatttaaacaagtttattgcttttggcttttggatttattgtttttttgaaaatgggtctgagaacggcctagaagaatgggtagacttgacatctaagtctatctcaattctgctcttgagaaaagaggaagaaattgctcagaatgttctatcataattttcttcttgctctttagatttctaaatggctacacaggtattgagaaacacatttttatcttgttatgaacactaaaattcattagccttatatttcctctttccttatagctgtgtcttgtttttgatggcttaacacttttccattctaatcaagctttgtcatgggctatgggctgaagtgccttgtgatggactgatttactttcagtccctgtaatctgtgcccttgaaggctagaggttgaaatcattaaggctctgctgttgcccttgatctctgctcaaagaggctagagattgattggttgacagtggttgacctggacgtctcaaaatgaagccgtgatgaaggaaaatcaagtacacacgttcagaatatttcataatgacatttattctgcgtgcattttttccagcggtatttttgcttctttttttaaaaaaaatctagtttaatcatttctagcccaccctcaccactaccacatgtttattccatttctacattctggggcacttaagaccttttaattccttgaattagtcatttataaatgttgtctgaatattctatcaaagcaaggcagcatagagaacttattattacacacttatcacatgaaaaaattatttattagcaaatatctattcagagcaaacattttgatcaaagttggcctcaattcactaattagttattatgcaaacataacaaacatccaatagaataaatattcactcttttctacagttttttttggaatggtttcagtgctggaaaaaaaaactaaaccaattcatgtaagaaaaagtaaatgtctgttaagagaaaagaccacttttaaatacacgttttaatatttctattttaatttctacttaaaaaggttaaggaggaatattctaaagacgaatatatttgcaaatactgtgggaacactttattgaaccaatttgagaactaagtcaattatattgaatttacatatttggttaaagaaaaaatgagaagtgattagattagttcaatatttaagtgaacttaacagaagtatccaagttcatgttgaccctattgcttcgtattaatattgataattacaaatatacatatatattaattttcaaaaatatagattatgagtgggtaataatagcttctaaaaattcactttggtactattccatagtggccaagtttccttttgttctctggagggaggtggcctaatttaggcaagtttagtatttagagcaaaaaaaaaggcagtctatgcagagattcaatggcatcttaaacctgccccacctatctctcattttttacattgctttttcattatcttttcctttcctttcgagagacttgaatttaatattgtctctcttttccccatgtttgccttttataaatctaagcatttctgccattaatactgtaggttaagaaagtggcagccaccatatttaaggaatagtaaaatctgtaactggggaaatatacagtcttctgagaaactgaaataaatttcaggtaaaaagtatgtgacgtcaattgagtggtgcacgtcgagggatacaaacctaaatacattccaggatgaaaatcgtgataagtttggagctccattttcagggaagtttctgtactgactttagaaacattgcaaccaaacaaatccttgggaactgtagaaaggactctttttagtgttcaggctaagtagacaatgcctacatatttaaagtttcatttggcagacttgacacagtaggcttcatggaacacaagttatgccttccttggtctgagagagagaagactagttctgctcaactgaagttaagatctgaggttcagtgagtccatatagatatcatggaagattgagtgaatacactggccctaaagcaacagaaagagcacaagttgagatacagttttaatccccaatgattggaatcaccactgccagatatcacatcctaattacacattctgcccttcaagctctggcaatacttttcttgcggtgccccctttctttagtttgccatatgaagagtgtggtaattactttccctgcagttgtttaccagttctcattcatttttcaagttttcctttctctctctctccttttttttttttttttttttttttagatggggagtctcgctctgtcagccaggctggagtgcagtagcatgatctcggctcactgcaacctccacctcccgggttcaagcgattctcctgccctcagcctcccgaatagctaggactacaggtgcatgccaccatgcccagctaatttttcttgtatttttagtagagacgggatttcaccatgttgggcacgctggtcttgaactcctgacctcaggtgatccacccgcctcggcctcccaaagtgctgggattacaagtgtgagccaccgctcccagtcgaatttttctttctctaaacaattttcagtgtaaaggtctgctgtgctataaatttgtgacacatgattgtgttgtagttacgactacgtaaggctctatggacaggtttcctttagttctgccagcacagctaaccagctaatataaatataaagaaatgcaactgttgacaccaaatgcagtttccgtttgcctgaacaatcaacaaataaacacaaaatctgaataaacattacaatgtgaatctatgtgtctgtatccataattatataaaattgaattattctaaagaattctatgtttcttaacaaaaatattatatgcatatatacagttaggtttaatagatttgtataagcatttctaattcttagcttccattgatcttcagtgtttcagaatatttatttcaaatcacttttggaagaaagtaagtttacaaattgtgaaaataatacacaaatcagagatccctatttaaaactaatccctacatcgcttcatcaaaatgcctaaaattcttttttggaatgaaattcacagagaattgcaagattcatttcctttacacttttattcactgccaataacttggggatactaagagtgcaggagaagcaggtaattctgagggcgttttggaggaaagcagttttgcattggctaagtttttaaaaaagattaaacatttaagtgccttgttttaaagatttgaatgataatgatttcaggtaattgatttttaagctatatggtaataataagacaaaaataattcatttgtttccttttggaaaatagattttttaaaagataaagatctgttttaatttttgtttttatttctaaggtactgtccaacctaaaaatatgaaagtaggtgtgcataagcttttttaaaaaaaaatcgccagtagtacaaacaaattttatagtccatcatttgcagggctggagggcttgccatatttaaatgtgtgacctgttttgagtatttgggtcaaagagaagggaggcaccagtgtttaaagtggcacaaacagagggaagaatgaaaatacaatcgaatatattcatttttattttcataaataaaagaaagtttaaaaaatctaggtacatcagtaatgttcccttagatagtattattatgtggctattgtttactctcctttgtcagcaacacgatcagtgattttcagcacctgctattgggttaataatggagttagagaagcatgagtttcaatttgtgctcatctactgcaaagtagctatatgaacttgggcagttacttaacctcgctaagctttgtttcctatccatacaatagggtcaagagaagtacctctcttacaaggtctgtgaaaatgaagtatgttcatgtgtttaaagtgtttagtaggtggcacatagtaagcactcaaattatatggactatggccattaccttgacaaactatattctctctccatttcctcatatgtaatgtggattaacacgaagattaaacttaaaaagtgcataaaaatctcagtgtctagcaatttgtagatgttcaacattattaaaattccctcctcaattttgcttactttgctgtactgaatgctatgtgagataggaaaggatatcaattatttgctatgccccttccgggcactaaataaatacatgtttttgttcattcttttactcaatctaaaagttattgagcaccaaataggcatcaggaagtatatggacaagtataggaaacaggattgatatttacaatcaggagaacaattttgagcccccagtcagtcacttgatgttatcctgggcaatcaatggatagagtccaaccactctaagcctcagttttcttatttctacatgttgatagtattaatagttgttataagatttgaaacctgttatggactatagtattttgtgcagacattagtcaaaatcataaattattttggggagcacatttacattcctcacagtgaagccttgggccctacacctttgcactaaattatacatctgtagcaggaaaaaaaaatttcagtatcacacaaatttaagtgggctaaaaatggtattttattaatttttctatagctaaattaaatttctattttggttcctcttttaatttaacaggtttcttaatataccattctcaggaaatcttaataaaattcagtgacttttcaggtctaccggtcacattcaggagttgttaggactctagcctccactctaggattggaataacacaggagtattacttagcttcatggcatcagggccaacttctgattctaggtcaaggacacacagagatgtgacatccaatgtggtctgtggggaagaagatctttgcatgcaggcattggctgaagtgaaccagtacctgcatcccgcccttagttgaactgcctattctgcctccaggatttggggtgtctgtgtcctgattaccacacccttgaaagactgccagcttgctcctcctaacttccatgaccttctcaagcaccgacacatgttagctgcttatcacaaacctgatgagatgctcagacccctgtgaggctaatctacatgcccagtccctttgctctggttgggcactatttttcagcagctccagaacctccttctcttctttaggactttggttccctaagaggacattataatgttcctcttatttgaaaaggtgtgtgtgtgtgtgtcagagggtcaggaccctccccacacccccacacggcttctagctctcacttatctgtaactctctcaacttccccctcttcttctcttggtaggcacctagagcaggtaaaaacttttaaacaggattcttctatatctgtttatgccagaatcatggttcacttacactaaaagcagttgacctctgtcagtgaaatcaagagttgattttgtaattcaagagctctgtatttataaacaaccctaaggcagtgaggaaacagtgcctaacttaccttacttgcaaaggatggaacttaagaatgtggttacaatctcacgaaatacttgtgtgtgtgtgtgtgtgtgtgtgtacgcacctgtgtgtgtgtagttctgaagatggcattgttaggtggtggaggcctataatattatgattctcaacatgtgaattgttatcacaggcaactaatcctattgcctcaggtttacaatctgtaaatgggaaataaaatgcctaatgtttgttctcagcctagttgtgaggattaaatgcaaaatacagcctcaacaaatgtgagttcccttcctcacattcccttgtaaaaaaaggactttccccaccccccttttatttagcatatcaacaattactcctttatttgggactgaacagccttttactaactatccttttgtttctcattttttatattcatgcatagtacaacttatgaaatattttaccccaaatcctcttgggtctgctttatatgcataaccaaataaggcatatttttatacaactattgtgttttatcttaaggtaaatttcaagctaaagtgaaaaatgaattccttctggtattcaggcagaattttccttacgagaagtaggtcaagaaacattgaacgcagaataaatttatctctgaatacggctcttcagctctggattgtttaaggatggcctagaatctacgctgagcattctcttgcatctcctttttcagtatggttctgaattagcactcgggcataaagcatttccttggaattgctcttatttttgtccccatattctgcactccatcgtcaggtaagaaggcaatatgtagcagtcatttaagaaaccagcacataaattatttccgaagttaaatcaatgtgcatcttactggttcagttcacagttaactagaactgctggggcttgcttttatgaattgtcccattccctccttgctttctttttgagactgactcttgctctgtcacccaggctggagtacagtggtgcgatctcagctcactgcaacctcctcctcccgggttcaagtgattctcctgcctaagcctccctagtagctgggattacaggcatgcaccaccacgcccggctaatttttgtatttttagtagagacggggtttcaccacgttggccaggctggtcttgaactcctgacctcaagtgatccacctgcctcggcttcccaaagtactgggattacaggcatgagccactgcgcctgggctctctcttttaaacaatcataaatatgaaattaaatgggctgactggaagcaaattggtctgtaggaacgcccatgaaagtgttccattctgattgttttcccatcctgcagcccctctggcctagtggaagctcctttcgttttgcagatttagattaactggggtaggtgagagagggcagggatggcaggccatttgtctctcatcaccgactgaaaagttgagcctaatatataccttttgctcctctacccaaatgaattacaaaattctaattccctcacacaccggggcctgttgtggggtggggggaggggggagggatagcattaggagatatacctaatgttaaatgacgagttaatgggtgcagcacaccaacatggcacatgtatacatatgtaataaacctgcacgttgtgcacatgtaccctaaaacctaaagtataataataaaaaaaagagttgattgtttttataatctaaaagtaaagacagtttggttttgtcaaaacttctttgttttctatttattttctctatagcttctaaatttgtgttctgcttgtgcatgcgtgtatgcttgcatgcatatgtgtgtgtgttttccttaaagagtaggcaaaaaagggcagaaaatagatcattcccttataaacctgacaagtacctgtttgtttctttcactgtggtaactggaaggctggaaatactgagcacttcagtagtcattctaaaaagattggttcatgtttaatttgtttgactgcccaaacctctaatggttcagtgaaaccttcgtgaggattttaagaaatagatcaggtgatagtttcagttgaagctactaaaaaaagcctttttgttcatattattttattagagtgggaaattgggaattctaaaatgttcccacatttgtcacccgtgttactctggcagccttttgtcatgttcacattttccctgttcgtttgttactgctgctgaatgtactttaatgattctaataggagctatagattgtgcagaagaataacaagcttcaaattaaaaaagaatatatttgcattttgtggcttctaaatattaatacaattgaattgtttttgttgaccactgtacattgacttcccagggtccggtgcatagcaaattcatagatgctccataaaataattatagaaccatgcattcgtgtgtgctgtgttgtggttctgggtactaaggatgtctgcctgagtcctgaatgagtcttaatctccatccaagttgtgtgtttcagagttgggatggtgcaaggaatttgattattaatgtaaactttagataactcatagcatgaataacaactgtacagtagaagaaaaatgcagaaagaataaaaaacacaaacaacagctaaaacaacaacacataaaaaacctcaaataattagagcaacaggctgtgaatgcatttagcaaacatatacccttcacttacttttgggaatccagtaactttctcctctgagttcaatgaaaaatcagtagcacttacgggtgtgatcattaactttgtttacttttttagctttcaatgacattcacgtttgtgttgagatttgttttttctttcctgaacattttatcccattcgccaatccagaaatgatagaataggaaaagaacaactagggctttatgcaagtacagtaaaatctattgatgcccctctacaaaaggctgcaaattggaatggctgaaatcatctgctcgtcttttgtgttgcattttaggactatcaatgaaacttgaaatgatatattaatagaaagtttgaacaggaattatatattgaaaatgtgacagaatgggtagatccaatcatcctaggctgttgagaagggaatatgcctcacagtcttgtactttttagatgaagccttccaatttacctggcagcccacctcatggctcagtgtttagtcatatagcagaggttgttacaattacaaaagttctcttttttttccatggaaaattgatcatttggagcagtagattaatttatttcaattttaaagtatgagaggcatagaggtacattaaaaagaacaaagactttgtagtcagagacatctaagagttgtgtaaacctgagcacataagtagcattttcttatctatatgatgggatggggttggggtaagaatatatatcatataggcagttacaaatataaaccacacatcacgtatggattttttttttagatgaactcatttatttgacatattaaattagacaaagaaatatatatgtaaccagataaaaacaatcacattctcatactacttgaacacaccgcagtggtcaaaaataatggattgtaaaatggaccccaggatttaatgcaaaaaccaccccatacgagaaaagtttcaggcttctaacttcactgaatccagtactaaacgtgcttctttatattcctcagcttcttccaagtctttttcactttctaatatctgttgaagatccaaatatgcggcttccaacctgcgctggcaatctgggatcatcatccgggattcttgtaggatctctgcctgctttttgatgtcataattttcaccatcttcagctctcattttttcaatcttttcttcttgttgttttgcctctttttcatacatcactttttatttgaccaaccgcttcaccacaccggtcttgatcttgatctgtctcacgcgaggatcggccatggtccctcgagccccgcgagaaggaggggcggaaagccggggtaaccgtggagggcgacgcgcagaggcggtagctatttaggcttggtcgccggcgcgcatgcgcaggctgcgcggccacttaaggagtttttataataaatcattatagtgtcataccttccatcaaaggattgagtactcaggtgtgaacattggtaaacaatttttccaatattaacatctgtagtattttaaattatgtgtcattttaaggtactgttattctctttgtaatttaacattttttataatagaaataattttgcaattgctacattaacattttgagttgattattgcttattgttagcaattccattgcatcattttacagattccatcactgtgctgaaacatcccatctgtttgtgaaagttttggatgttttctttagtatctagatgaatctattccttatcttatcagtcagagatattttaaagtccttgtctgttagttcaagcatataggttatctcttagtctggttatgttgatggctttacttcttgataatgggtgtattttgcttagttttatttattttttgcaagtctcattttctttttagtgaatgttagatgtcatgtatagaagaaaaatagagaatgaggtaaatatgtttaatcttggaaataggtatagctttttttctgtcatactgctagtatggggtttgagtcagtggtgttagtattgagctggtttggaggggcgggggttgttgttgctgtagcaaccttcagaacactacagtcttcaaagacctccactgatgggctgctgctatcccgtgcttaatgtaatagtgtctgcggtcctaaagggatttctatcttcttgttccatcctcagttttcagcaagccttatatgcctgtctctcccctagtggtaacagatcattctgtttttattggtgcagaatcctgggccaaagaggttatcatactgctcttccaaagagggtatcttgaccctctctcagtggcttctaccttccccaacccctctgaacaggcgggtcccatgggtggtagagtttagtatctttccttcagtttagtatctttccttaaatcttacgccttttagaagaggagggtctggaaaatgggtttgacttcatgtttgtgtgtcactgaggggagcttcttcctatctcttgtcctacgccttacttttttgcaagttcccaatagaagtttgtggaaaagaattccagaatgagtgcagactccttcggtctgcatttccaaggatgctgaaatgtcataccagcccacacctgacttttaagaatgccttacaattggagctattttctttttcctgctcctacgatgactacttcttcctccagttccctgccaaaggtaaacctttcatgtatccagtctctccttggaggagattgaagtactttggctcacctcgttgccttgtggccacagctatataaatggctcaaaaaataatacgtttttatagatcaccctgctttttctcattgggtggagcaacgttcttatatagcatttttacatcctaagcagaagaggaacttgattatgatggaaagcgtaagtattttaccctcttgggatatccacattcgacatgttaatcattacagttacccttactttagatggaaacaatgaataatacttatttttattagagaaaggccgtagtagataagtgatattttaaaaattgaatttaataaaaatgtattgaggacctgttatctgtgaatcacccaatgggaaaagtcatgaaaagctgaagaaaacacttcattgtatttcagagcttttaatttaaaggtgaagaaaaaaggtgactcaaaagcattttgtatattcagaatccatttgtgaaacctaatttgtgatgttgaaactgagatttggcacactgtccaaaattgcattcaaaagtgtagaacctgctgtcctggcctttttgttttgtttgtttgtttggtggggtggggtggggtgggcgtaggaaggaaaaagaaaagataaggagtgtggtattgactgatagtttattctcaagtgcagtcaccagggagttcgaactgacttctacttttgaagttgaaacatggaagcagggctccaaaattttgtatctcattgaagtaacttagaatactcacacttttatgaatgattgagatacttcctaaaaatttaaaccatgatatctccaacaacggaaaagagggaatatgaaacccccataggctacgggtgtcaatcaaaatagtcttcggagaaatgaaatgttttcttcatttactataaaattgaagaaaaaatttcatttttcttttttttcttttttgagacgaagcctcgctctgtcacccaggctggagtgcagtgacgcgatcttggctcactgcaacttctgcctcctgggttcatgcgattctcctgcctgagacttgcgagtagctgggattacaggtgcatgccaccatgcccggctaatttttgtgttttttagtagagacggggtttcgccatgttggccaagctggtctcgaactcctgacctcaagtgattcacccacctcagctcctagagtgctgggattacagatgtgagtcaccgtgcccagccaaaaggttcatttctcaagttttacaaaacttttcagtcaaaattcacatatctactgtcacataattcatactcaattacattccttcaaaaatgctctcacacaaagtttgaacacatcgaggcaggtggtttgaaacatccatcccaaagttgagctgggagtcaaggtgacaagaatggcccatgagcagtgagatgtctaccaatgccgggctccggggcaaacaactaacattaagtgcaaaggattaaacttgttaattaggagaaaataaaagcaggcatttgcttattttattattgagtttatattaatagtaatcacttccattcatattagatgcaaaggaacttttaatattctatgcactgacttaaacttatttcttaatccctttcatctccttataatgatgcatatgagattattggaggtttggaggtatgcactaatgcaaagtgatgagctgtaaccaaaaagtaaccaagaaaataaaatcacaatttcatgcatgtatttatatttgtcttctatggcaaaccatggggatattgaaatatgaaatttcaaataccctctttattatgttagatgcattatttttaacaatagaagccttaaataaaatattaagatacatttgtattttgacacttaactgcccttggcattgtgcatttaaacttttggtgtctagcaaagttaaagggagactgtctttaaatacatatatattgatagtgccattttgttagacatgtcatctttcgaatgtaatgatattgttcacacattgattttattgatgatgttaaatcaaaatggtttctgcaattagtaacttctataaaacaaacatattaaaaggaaatcatacttcctattgtagtataccaatttatttttccatttaggaatagctatgctccctctcatgttttgttttgtataccttactaaattaaatattcattttattctttaccagtttccatcacagacacaatcagtattatttaaatttcagcaagaaactaaacaagacttacaagtttttcagtgctaatgatttttttttctcattaagtctgagtctaatgaaactaaacagaaagttctggttggattccttggtcacccctatctgtgtttgtgaattcctataattggcatgaattgaaagttcttgttatcactgatagtaacccagagacaattccaatttgggtttaaatggccctatgcagacaagggtaactgaacaaaccaaaacagcttcatgtgtttatggcagataaataccaattaagtactagaaatgacatcagggttttttttttttcctgtatagtttcaagttaagagactttttctcccttgagtttgcagatatagagcatcatgaccttacaagaggaaggagagcaacttcccatctgaatgagagatggaaaaattatatgaaatagaactaattctactgttaagcagtaaactacttattacttgagtattaattaggacacttggctacaaataacttataccaaatttgaactatctttatcaaatgtggaatttattccaaaggatacgtttattctaaggattaaaatgtttctcaaggcaggttagggcaaattgcagtacacctcagaaaatgcaatcaaaaccttccaggactctctgtcacatctccttctctctaaactatcttttttattgcagattggcttccgctgttcctcatgtagcagaccatgattgccaacattcccttatatttatatctcgcagttgaaggattcagggagagcctgattctaagacccaagtctaaattctttaaatacatacgtatgtatgtgtatatgtatatgtatgtatatatatatatacacacacatgcattcatgtttagatagacatacacagacatatatgtgaattacattgaattacatatgaattacatttctatttaatgtattcaatgtaggttacaatgcaacgttatagaccttttcatccattacaggtaggaatgtggtttaatatggaatttttgagaagtaatttgaaaatatgtaccaaaacttacggagatgatttttcacctaaatccattataatttttgagactcttttctaaggtaataatcccacatttgggtggaggctttatctatattgatagtaattgcaagactattttaatagcaaaaattatgagaccatttttcaaggttccaaaaaaaagcagaacggtaatttttatgggaacaaagaagacaatgcttctagatatttaaattgtgtttgaacaacattggaaaacctgttattttaaatgaagaaagtaaggtgtctaactacttgtgcaatgcaattacaattatgcaaggaaaatgcaaaggaaatatatcaaactttaaatcctaaagcttttaatactcactttttctctagtttctaaaatttggctaataaacataaatttaatttataaattaattgaccttggcattgtataaacatcagggtaaataatgcatctgtctctctgtctctctctcgctctctttattcaactttatcctaaagcatcatactaattacaatctattggttttagtttgactcctcagctaggttactcaaacaatgaaagactacttttaatctctgaagatgtttctttatcttgaattttgatttcctaatcaatgaatacttgtctaaatttagtattaagttcacacacatcttttctcttttttggattactttgccaatcaataatgttcctcttttagcggttactggttatttctactgatctctgctgagagtttattctcagacactttcataccacgctttgaaaatactggtttccaagctgtgaattcactgtatctatgcagaaaggagtgatttgtttcttgtatggcatgatgttttttatatcctgtgaaaaccatcaattccacatttgagtggttccttcatgacatgggctgctctaactaaagaaaaatgtgcattaaaaatatgtgtccgattaaggcattaaaatatcttaagcagtcaggtagcaaacaaatctttctgagttccaattactgtattacattatgtcaatacttactgtcaaagtacattacagaaaaaggctgggctcttttcagaaagggcattgcaatataatgggtgacaagaaactgcatctgtgtatatggaagcacaagaaactaacaacaacaaaaaaatagtgcccaatcctaggtggctgaagagtaatatctaagagaatatgaagaaaacccattatttattccctaggccagataaggagccctggctttctctggcatagctgcagtgtatataattatacctctttcagtgccaattactgtgtgtatatccataaaaagaatggtacaatggtgacagagatgaagagcagatctcttaaataaacatgtaaaaaaaagcaaagtaaagaaaaataataaaaacaggtctattgctgttaatgccactgttccagaaaaaagtaaaacagagatcattaatatccataagagccagaataatgtctatatttttcatccaacatttttcaaaccatggagcccttttagaatctgctgatgactgtggactctcatatatacacactcataaaattttgcccacaattttaggggtttattccatagtcgtattgaaagcccatagatttcaggataggaataacaatgttgattactcatttggggccagacactttctatgccatataaagataatggcttatttagtcctcacaacgacactatgagatagttattattttagtacctattttacagatgagaaaactaaaggaaagaaaagttatgtaaataaattgagaaaactcagccagtaagcggcaaaactggactttaaatccaggccgtatgattccagagcatactccaacaaggactgtaaactgcatcctgcagaaacaaataaacaaacaaaaacctagaataaagaagcagatgatagagttttagaactggcggaacacatagaaattatcttttccaaattctatgttttaaagttgaggaaattgtattccacataattaaatgattaacagaagcccatagagcaagttagtgttagagccagggttcaagtgggaacattcatccaaagctcatgacaaagctacaccgatattattatcattattctacaggtgaggaaacagaggcacactgttaataagtagcagaactacctttcgaacccagataggcaggttcaaagctaaaactaccatattactgtaattcaggaaagccattccctttataattcgtttagtaggcgctcggaatgatcaaatctttaaattagaaaattcgaatgtcttcaatttacaaactttggaaattctggagattctactttacaatcattttaatgttctctaatcaaaaactaatgttttcagtgtgctacaattcatgaattttatattcatatcagaatataaaattatacacatgcatatatgaactttatatgttatatatgtatgaagcttatgtatgtatataacaatatgtatatgaacacaacctgaatacatatgtatatatagataaccattcaaacattttaaattggctatagaggaaagcaatttgccatttgacttaaagtcttttgtaatgactagaatttaaaataaagtttacaatttatgaagatgaaataaaactatacttaaaatgctgtttttcgaaacagaaaattcccttaaaacctcaaaatctattgtttgttttatataataaaaatccaaattttttctacaatgtctaaatcttttgtaattctgttatattttcctctacaagttcaactcagtgatacctaagtgcaaacaataaggctagtatgagagctttttttttttgagacggagtctcgctctgtcgcccaggctggagtgcagtggcgcgatctcggctcactgcaagctccgcctcccgggttcagccattctcctgtctcagcctcccaagtagctgagactacaggtgcccgccaccacgcccggctagtttttttttttttttgtatttttagtagagacggggtttcaccgtgtttgccaggagggtctcgatctcctgaccttgtgatccgcccacctcggcctcccaaagtgccgggattacaggcgtgagccaccgcgcctggccaaaagttacttaatttgcatgccaacctacactcacatctattaaatgattagtcaatcaagatatagacaaaactcatctattggcaatgtacactgagggacgtgttctcggtgtagtcctgtcaccgatcttagtacagaaataaataccttttttaatccagtggcataataaacctgagaaaagagaagtctttcattaagaatcttggaagaagcagtcgttaaccacttgtcatcagtattagcaactcaagctgaataaaaattgattgtgtgactctggaccttctttgctctgccacttggataatctattagcattggcacctgattaactctcaaaactgtctcctcttttgattagctcccaggatttcttttgtattctcagtaataattttccaaacccttttctaaaagactgactctaatgttcttttactgactgcaaagtttcccgtcagtgctgaaaacatgtttggccttcattcctatttataatttttggcttgatctttcataaacactggcttaagacttccgtatttggtgaacagggagtgaatgattactccgaaactttatttctgttttaagtgctttcagtatttggcacaaggtggaaatgagcaggctcagtactgaccattgctattacaataactcactgcatttccttaaaacttattttccacttaaattgttttctacattgatttctgtctgtgctaatacttggccatgtatgagaacaacctgcttgttttaatgtttaaattttgaatggtatggtaaggagaaagaccaagatttaaaagataatatattctgaaagggcaatttttggaaagcttttaatacttcatttaaaacccattcttcagcttattttaaatttaatgatggaatacaaccctctcttttttaaatgaagaggttatatacattccatcattattgaattttattctatgggccacatttactatttacctgctatattagtcagctttattataggctaatgctctgtaaaaaacaaatccaaatctcaatgacttataagaacaaacatttatttcttattcacatgtcaggttcaattttgtattgagtacaggtcagctctatgcatctctccttttaggaacagaggctacctgaggcgtgtacttcccctgacaaagggaggaaggaccaagaaaagtgaaaacactttatgattcttaagcccctagctcagaattgacacactctcatatctgactgtgttccactggtcaaggcaagtcacatgaccaaggccacatcagtgagtgggatgtgtaatccacccatggtgaaccatggcaagtggaaaggaggaagaaaaagaaaccgatgagcaaataatgtaaactaccaacttgttcaagaagttctaatgcaattaaatatatagtcaggaataataatactgatctctattggcacttactttgtactaagtctttgcttaagactactttcgatgctttacaggatacctcatcaaagtgaagctaagagtttttttaccacgattatttcctcttttcagactggaaatcttgggtttggtgtggcttatgagtcttttctttctttgttttgtttgtttgtttgtttgtttttgagatggagtcttgaactcctgtcggggctggagtgcagtggcatgatcttggctcactgcaacctcagcctcccaggttcaagtgattctcctgcgtcagcctcccaagtagctgggatttcaggtgtccgccaccacgcccggctaatctttttatttttagtagagacggggcttcactgcgttgatcaggctggtctcgaactcctgacctcatgctgcgtccacctgggcctcccaaagtgctgggattacagacatgagagactgcacccggcctatgagtcttttctaacactgcataactagtgcatgatcaagccaagaaatgtgggcccaaattccactacagagagcagacaataacgatgctcctatgggccattctggattacatatcccatgcaacaattgaggagccctacagggcatgcttagcaattgttccattgtttttttttttttttgtcctttttaatacatagacttctgtccctcgtttattgagggttgcccctgggagaactaaatctctatcacttctggactgccctgcaaatgggcttaccaagccctcctaaactgaagaaagccttaacacaaagaaacagagagatgtggatgcttgtggtgaggaatcttcagcatccacagaatccgttcactatagttataggtgaactcagggatggctcggtgaaataagggatgaggcattatcctcatctactatgccattttattaacctttactccatagtgtaagttgagtaaatacatcttgtgatttaaatatccccttataatccaggccctgtgtttgaccatttgtctgtttctaaagcatctcattaacagtatgtttggaaatggctgttgtgtgtcgtgcacatttggctgtttgctttccttttggtttgcaaagaagtattttgcaacccataaaaatagataaatatacaccacagaacaatgtatttttttaaattttcaggggagaatttgaatcttttaaaagtaatattgagtaggcagctgtatggaaacaggcatctagttagcagttctgctacaatatccaagtagttaatttcacctctaaattacactggagaccttgaccttattttgatttattctgtcataattagtctatggttattactttaacaaaaataagtcatctttctcatgaacactaccaaagcacatttcaagtctgcatactaattaatagtaacttatttttactcctaacaagtctacacccacatactcatgtttaaacaagatgagatatttgaaatcactttataaattataatgcaccacagaaatatccattatttccattattactaaaaacttacttcattcttttgagcatgaggaggtataatttatgtgaatatcatttcatattttgtttttatctttcaaatcgagaagacttgaattttttgcatatttacaaatactataaaaatcctactaattattaacatggctgccacgtagcaatcgtgtctattttatgaaataatgtcatttatacagaagacccacgggaagttgtaatatatttggaagtaaagatttataggttttgtctatttttttctctttctcagcattaatatgtcatacatgtgtcacatttagtcttcacaattcagtatctttattactattaccatgaaacaaatagaggcaatgagacacagagaggttaagtaacttactcaaggccacagagataatgagatgtgaaactggagttggaactcaggttatttgactctgaaatgagtgtatgatgtaaccccggcctgcattgtatctaacacatgcaattttaagaggataagaattaactgtttgcacaatctaccagatggcactgtttttccaactgagaccacttaacaccttttcatatactcttggagttctgatcattcttccactctaatacatttcttcaatctcattgtcattatgtcctacttcatgcaacttcgattaattcttcacaagtatatttctacaatacttgtgctatgtttccaatgtatagagcattgcaatttttatgaatatacaactatgcgattatgttaggttctcaccataactccaatttgctaatggagcataaattctgtgattaagtggcagggaatgggagagaacttttattcaatatgagctgacatggctttccaatctggtttctgagtccaacaactccctacaataaaaaagcaattgacctacctgagaaagaagtggcgtttgcagtggaggcaaaggaacagacaggtcatccatagcattttacattgtgtcagaagcatgacagtcatgaaagatgaagtaaagggcaattatatcatattacagagtgaaattcacctagagaaataaaggcagattgtttgcaagaaatattctttctcttaattttttattcattgtagtgatgaaaataagtagcaatatttcagttccaaggctaaattttggggagaagtcattgaaagttagttttatgtctaatgggtgctcaatggataatttaggaaatgaattggtgacagaaggtctataattaacagagtagtttgagcagtatgatgaagtgcagggggaaagcattggtctaggacttagtagatctgagatttaattacagtattgattagtcacttgatttattcaacaaacccttactaagtacctatttctgcttcagtataccatgtttggtgccaggagttgcaaagacataataattctcccatctaagtgtggtcacatttaggaggtaatgagtgggatttgggctgcattattggaagacaacaaactaattttctgtttgtgtgtgtgtatgtgtgtatgtgtgagtgtaagcaagatgagatatttgaaatcactttataaattataatgcacacacaattaaagtatctgtgtgtccatacacatacagttaaagtatttatgtgtgtaacacatatgcataattagaaaaaagcctacacatatgtatatatcagaaggattgattgataagttatgccagggagataagtgtgattgtgaaaaccctcacattcgacctagatcttaatagtgagtgtcctcattctagggagtgcatgaacaaaggactaaagcaagaaagcatatgatttatttatggagaaatttggcttgtgtgactaaggcagacctggtagatgtatataaggtttgggatatgggtgactgccaacaggcctaatcgataatatgtttagaggagtacactggagtcaaattgtgaaggcccttatatgccattctgaataatctagcctgtaacctcatcagagaagctctggatttttcaagttagttctcttaatatatgattgtaacagaactgtagtttctccatcagggaatttagctttatcattgattatccatgatccaactcccctaactccacatataattaataattagtacttaccaatactaccccgtaaacacatcttgaatgcacctactccttttccagccccactgccattcattaatgcaagtcatgcttacttctcacgtggattataggtataatcagctcatgtgtcttcttatttacagtttatccccaaatattctctacactgtgaaatttatttctaaaagccaagcctgacattgctatttccctacttaaaattctgctttgatttcgaactgccctctggctatattttcaggctcttcataaataggttgatgataatttcactttttctagggtcatctctgccatttttatcctcctccaccatctctaggtctgggaaaggaccatactctttctctcacatcctgacactttcacctgctcttttgattttctggagttctcttttctaccacttgtctctctgctcttaattaactttcaaaactcagctgagatgtcacttcatcaaggaagctctggatttttcaaggtagtttccttaatatatgattgtcacatgactgtagtttcttcatcaggcaacttatctgtatatttgtatcaacatacccttttgttgtgtctgcttctctcactaagctagaaggaaaaaagctagagacactgcctttctcacagttgtttttctaccacctagtaggtgtcagtacacatttgtcacttaatagccttaaatatgaaatgtaatttattagtttcctattgctgctataaaattaccacaaatttagtggcttaaaattatatacatttattctcagacagttctgcaggtcagaaatccaaactggaacttactggactcaaatcatgatgccagaagggctgtgtacttttggatgctccaggggagaatctgtctccttgccttttccattttctagagaattcccacgttatttggctcacggccttcttcgtacatcttcaaaaccagccacctcggaccaagtccttctcatagtgctttctaattctccccttatgccaacatttccccccttttaaggacccctgtgattaaatcctgcccactcagataatctgggataatctccctatcaaaagttagctaattagaaagtctaattctatctgcaataattccactttgccatgtaacataatttattcacagatgtcagggattagcacgtggccatttttgaggaggcattattctgcctaccagagtttaatagaattaatatctgcagaggagaaaaatgagaagaggactaaaaagtaaatctggtcttcgttaacttaaaacacctttattgagcactactatgtaacacattctatgctaagtgctgggattacagctctgatccagacagtcactctcttggaaatgagaaaggatgtaggtgatgttattaagaacaacttttgtaggatgatgagcagtgaagactgcattacattgactgtaaagcgaatgggaaataaagaaatatctttgacatgaacagcttttctgttcttcgtgcagaagtttaattattttagacctcctcattgtaagctgaccactaacgtcacctcaggcggtagaaaaatcccataatcaaagactattactcagatttaatagaaagcatttttcataccattttccattgcagcctcctccactctgcactgccattttgtaatattaatggcacagtaaatccactttctaaatatgtcctaaatttgtttccttcctttataatgctccaaaatatcacataaccttatctaatgtttatcattaatcttccatatttttcatttttttctcatgtttgatggaagcagagaatagactgaacttaattgctctcccatattacttcatagttctttattttcttttctttcttttttttttttttttttttttttttttttttttgagacggagtctcctctgtcccccaggccggagcgcagtggcacgatcttggctcactgcaagttgcgcctcccaggttcacgccccagtagctgggactacaggcgcccgccaccacgcccggctaattttttgtatttttagtagagacggggtttcaccgtgttagccaggatggtcttgatctcctgacctcatgatccgcccacctcggcctcccaaagtgctgggattacaggcgtgagccactgcgcccggcttcatagttctttctttaagtgaaattaactcatcccattgcatttcttcactacgtgagtttctaaactggtatcaactttaatattcccttccccttttaaagatacattttctgtgtcacattagggatgaagatcttcaattaacatattaactagcccccaaggaaatatcatttaaaaaatgtttttctaggccgaatgtggtggctcatgcctgtagtcctagcactttgggaggctgagacagaaggattgatggagtccaggagtttgagaccagcctgggcaacatggggagaccccatctttacaaaagaaaaaaaattaaaaattagacagatgtggtgatgtgtgcctagagtcctagctactgaggaggcagaggtgagagaattgcttgagcccaggggtctgaagttacagtgagctgtgatggttccaatgcactccagcctggggaacagagcgagaccttgtgtcaaaaaaattttattttcttgtacagattatggttaattgctttgtgtaatgggaataattgttagtgtttatagaactgtttttctgtttttttttttcccccagtttttaaatgctttcacttacattgtttatctgatggcagagaagaggtcttaaggaggctctccagcatctcgctcctaactctcattgcaatttcattccatgccactccctttctcacattttagagtgcaacaaaacagaattgcataatgaatgagcgtgtactttcagtttcttatcactctgtccttgtccttactgtctgctcagtgagattcatctttatcctcctcctacctttattccttctttactttctctcatccttctgaactcaacctacccattaccttctccaaaatatcttttctaacacccatgtggctacatattcctttctccatgctcctataatacgctttaaatttatatatatttttgtttatgcaaaatgtttcatatttatctatgatgtgtctattatctactaggctaagagctctcccagactgaatcttgtttatattttcagtaactagtgcaatgtccaggtcatagtaagcattctgtaaatatttattttataaattattacacgagtaaatgatctcattatatcctgtcaatagctccatgagttaaagagcaattaatattctcatttcacagttaaagacgctaaggcttggcaattttaaggccacaattctaataagtcctgcaaagccactggaagccagttccacagatttaatgttccctcagtttgcccagtatcattcttctgcagtaacttgctcttgtgaatcaagaatattgcaatttaatatatcccacatttatattcctgagggactaaggaatataaaagttaataacagggtaaaagttcattgtactaatcttaaaaaatatgaaaggccacatatactgaataaaaataactttattagaaggggttaaagattactgagaggaaatacaatttttatgtcatgttagaaagctaattttatatgggatttccccgtagagagaataaaataaaacgttggtcagtttttgcaatttatgaagtagtggttcttcacttcttgacatctccagggaacagttttcaagtaaattttcctaagagagattttcttctttgcctctcttattaatatgcacatgcatgtttttattagtaaaataaaatcagttataaacaaaccctaaaggaaatgaaatagaatatgtgctgcttgaaatgactaaacaggagcatataatcattttgtaataaaacagctatcactttattcttttctcatttgctttgttgctgattgcacattaatatgttttactatagactatgtgactacagaaatagacatcatgttaacgtatcaaaatagtttctagaacaatttatatatgtgtgatgtgtatgtatggtggctttaggttaactaagggtatacagcttaaaatagtcaacttttaagcaatatgacaaatagcaataaaaatatatcaattcaagtaaatacgtataaaattttagcatactaaaataaaaattaaaaggcatatgaccacttgggaaaatatgtccattcactgactaaaagtgagtagcttaattttgatcgttaacttggattttatggttataggagttttctgcaaggaggtcagtgaactctatgaaactatatgcaaatatgtatgtgtagacatttttctatagagaaggttcattattttcatcagataatcaaatggagcccatgacttgaaatgtttaagaattaccaatatataattatctcattccaattaattttaaaatattaaatgctcaatagataaatgagccaggatgtaaacaagtattttgacaaaaataggaacatacagaataaataaatgcatgaaacatcttctacttcattagtaatcaaattaattatgattaaagcaaacatcaaggatctccttacatctaaacaaagcagcaataccgtaaaagactaaagcaacgaaactcctatgaatgacatacctgcggctgagatgataattcccaacctcattctttctgctaccagtagaagtgggtgtgatcacttggaaagtattataaagatatttagcaaaagtcataaaggttttcataatgttgaactgataattttttcgaagacaattataaaaacaaaaaagaagtgagtgcatgagcatgtttattgtgatttagtctctaatagcaaacaaaaggaaagagcagcttatatgagatttatgataaaataagtgaaaaagaaagaatattattttggttataagaaatatgtatttatggggaatttaaaagtgtggacacaaaaattttgattgatttttggatgttaaaatgtttccataatgatatataagacgaaaattgaaataccaaatatcaattagtaaatgtaaaagcattattatttgaagtattaacaaccatatcatccagcaccattaaagaaggctcattattcagttctagatcagttcatacagacaaataagttatgcattgccaaattccaggacgctattcacataggttacaacatacatggaacctccttgagttgttcaaaatagaagctctgatttcatggttgttttgcatttgcgttaatatgttcaccttttgtgactctgattatcttatggtattctgtattgttaattatgcaattataatgtaaatgatagatatctggtcaatgtgaaaagccatggactttgattcagaaaatctgtatcaagttcatttctgtcacttaatagctttattccttctcagcttgtgtttatgtataaagtagtaaattacatacagattgagaagacataattaaaacaaacttatgaatagtaaggcactaagaattgttatgtattttataataataatacaattaattgtattaataattattatgttgaagaaaatatatgctactataccaaaataagacaataattcattgaagacatttttcttgtattaaagacgtagaggtgagagaggacaactagcaaagatgtttatatgttgaagctcacatttagtgttatttacacagtaaataagtaacactttgcacataatgtcaaggttttcgtgctgccttcgatgcttacctaaaaattactccttgtccatataattgaaaagaataaaaattttattctactacgtatttttcacttaaaagcctctagattaaatcacttcaaaagacctcatattgagcttttggcagagggttttgggtatgtttcaaagacatctgaatgtatgctttcaactgactcatttactctctgctttctgacagaaagtacgcatgcacatgtaggaaatataagtggaattgcaaataaggtcatttacttttaggaatatatgtatatactactgataaatgatgcgttgaccaatcttcctccataaagtctatgaagatggtttaattttgaccatttgaaatgttccatttctttttaaaattattttggaagggctagtattaattttatgaaagtaaagatttgaaggaggctagaataggtttgaaaactattactatctgtttttatttattcacccttgtcaacaaaggaaatacttccatattgtagctaagatttatcatataccatatgaataatgttgatattgaacatacatatagaagcttgtgtgaataacataattaaataagaaaaatgtattttgtaatgctaaataaaatttctcacctaagatgacagtttgaaatttatttattcactgttatttctcatattgactaaaggaatctacttatagattagtattgtgatttaaagataaacagatatttttggtgcatgcatatatttgttatgcgaaagtgattccttatgtttttaagagaagcaacggagatttactactgaaaaatatatgagagcaaatatgattactttgtaaagggcattttaataacggttcttttaatccaagtagataaaatataaaatttatcaattttaaatatctctcagatgcattcatttactgaacattaactaatatgattatatttacaataattaaaaaaatagtcttttgcttggagaaaaacattttaatatatcaagattgatgatttttctgtccatttgacttaatactaatttccagtttaggggcaaaaagatcatttgtagaagcatgaattcagtgaagctgttttttaataatttttctccctaatcccttagtataaatctttggggacttttttctttgagtatttatatgtaaggcatgaagagtatcatttgcatttttatttgaaatgttctgacttttagatgaaaagaggtcctagaaattttagagttgtagaatctccccttccttaaagcatgcacgtatttgtcagatgtattttctgagctcttaatttgttcagacagtgtgctaagttctgggaagcaaagataactaaaccatgctcctgctcatcaggaaacctcttccatagtgagatcaggcccatgttagagtatgtagatgctgcaaaggaaggaataatcatttctccatggttgggtggatggcatggggaaaggctccgaaatagtttttcggagtaaatgacagctgagagtttcttttaattatactggagtatctattcataactggcgaataaatactgttattcagaggagactatttttttataatcatacagtatttgaacgactatgggtttggtcatattaattgtttttcagatattacaaatctgaggcgggatcttgctctgtcgcccacgctggagtgcagtgccatgatctcggctcactgcaacctccacctcctggattcaaatgattctcctgcctcagcctcccaagtagctgggattacaggtgcatgccaccatgcctggctaatttttgtattttcagtagagatggggtttcgccatgttggcctggctggtctcaaactactggcctcaagtgatccgtcctcactggcctcccaaactgttgggatcacaggcgtgagccaccgcgcctggccatttttcagaagtaattttaatttggatgccccaaaccagcatcactcatgtttaattccatttatcaatgaatgtaatactaaatgtaaaaaaacactaacacatcataatggaaagttactttggttgtaaaatatgaattatatttaaagttgcttcctaacttttatttttttattttgcattttagatgaaagagaagatgttcaaaagaaaacattcacaaaatgggtaaatgcacaattttctaaggtaagaatggtttgttactttacttttaagatctaagttgtgaaattttcaaaatggactatgtacctgtgtatcttaaaaatccgttttatttctctcatagtgtcattttattttagctgtgcaaatctggaaatattatgttcactcttatttaaggagtaagcagcagaagatatggcaaagatacactatttaattatataaaatgtatatctttgattcttcttgacaatgtgagtttctttaatgacatgagtcctcagagtttatagctgcaatcttccatcaagtagctagaatatgtcacccagcagaagaagatatgagggaattttgttgtgaaaattatcatttttttgtccctcttggtctttaccaagttcaagaaaagcaatataattgctttgggtgtattcagccactatagtttagagcatatttcaaatgattaaagacaataagttcatcttgtttttgtgcaggcttcaatccatactcttaatatttacttaatttgcaaatacaactcaatttttaatcaatagcgtgactctagatgattataggtggacacagagcaagatattcttaccttgaaaactagtattaggaatgcaatatatggaggtttattgggatgtcaaagtttaaaagacttgcattttaattattattctcgatttgggtaaatcaatcaaatgtttggtgagtcggttttcttatgtttccatcatgaatgtttgtatatgtatatattgattgcttaattgagacatcaaatctagataatggaaaaataaagctaataaaatatggcccttaaacccaaggctttaagagtggcatagttttgatagtggatattttgtttcttattgtaatgatttaaagagtcactaaaagtgaaaatttctactaaaatgcctgaaactcttaatagctatgaattactccctctatgggtctgattttgtaaaattcatgataatggagccaaaacaatccactaggagatccaatctcaaaagttctcccttttctatgacaaacatttttagaatatcgtctattctttgtggtatttggtagtagaatgttgccatgtactctttaatttaacttactgaattttaactaataaaagttcattttatttacttgctgaataattaacaaatttctattacagacgtaaacagaaacatgtattttaaaaacgttttttaaatcctcaactttttttagctaagtgaaataaaatataacaacacaaatatagaagaataaataaaaagtaaacctaggatatttaggaaagttattcataattctccgaatatttataagatggttatatatagtttaattgctgtatatactggcatcattgacatttttaagttttggaattctgaagcagacaagagacatattttcaaacaaacatacagacaaatcagaattgtgaagaaattttctgaaatagtaaatgtaacaatactctgaatctttgaattgaactagagtaatttttaaaaggtgtgtaaacatgacaagtactgtgtatcctcattcccgcaagttgaaatagatcttcgctctgtgcattaaccttttccattatcatttatcacaactcacctgttaatatagaaatcaaagcttgatatccaatccatcctctatttatatattgttagcactgcctcagagcaattcggtatatttttttctgtccttatgaatgcccatatcttaaaactgtaaaatattcacatatatgagcacatttattgttttcttccaaaatatttgcatcctctaactcaactcacacttttcatttatattacaaatgttctccctaagtctgttataactgatcaggagagtcaccattctttcaagtacagaaattctattatcaagcatatcctaggtgtcaggaatagaaataaaagtttacaaagacagaggagaaaacttatttaaaggtaaaatgtatatatacctgtgcactaacttctaattttgagaacttgcaaagaatctttttcctcttttcttattcttttctgtcaaaacttagctaagtgactgcattcttttagacacttttgaagaagatgggaatttagaggaagctagttgattcagtttaagccacttggtgaaaccaaaagataaacataattgtgatatatatatcatttggcaatttattgcatcgctgcatgcctttcagcagaattctagccctgtaggatacacagattagttgaagtggaatctcctgaactcatggaacctacacagttatttgggagtttttggttaattgataaatggagttagaactgagtgggctcagtgtgggtggtctgagaaggcagtaatctgagctagagggaatctggtaacctttatgaagaaagctctaaaatgtgagcccatcaaaggcaggaatgtatatcttctatataatctcattgtttattactagtacactatataaatataataaatatactaggtcagtagtacaaatcattaaatctatgctaactgtagaaacagaagaaaaactgggtggaaaaattgtgttgaagaagactttaaaaagagaaaaaagagaatgaaaaattctgtctgtgtggtaaattagacacaggcacacacacattcatacaactataaaaatgcctcactaataaatctaactcatattcatttttatagtcgtattaatgtctatctgtgtctactttaccacacagacagatgataatttttcattgccttttatacacacatttatataatatttgtaaattatagagagacaacaaaatatttccttgttattttgtaaagctacggaagggatatttaaaggaaataaatgtgattaaatgtatccttgttgttgtggcgtcatttgaagccaaatgtgtctttgcagtaaatctaactgattttccactttcctggtaccattttaaaaataagccctatctctttttaaaataagtcttctattaactttgattccaaaaaattctactagaatgtgatttatcacatctattatatagagataactgaacaatatttatctccacataaacacaaaaccatttctagataagattaattcagagtaaatattctttccatgtaatttattgatatgttataatcctttaaaaagcctcgtgtatactctatgacaaatatgattcgcattataaaaatcttgctcatccatgccggcttaataaagggaagtacagttttgaaaacatgaccaaaaataattttgtcataaaatgtgcttgatgtttgtgtttgagaaaaaattttatgggaaaaaatatttactgccagctcaattgagagagataaactatctcccaatgagtgatatgatggttttgatcctatactgaatttagtaatcatctttatttccatactcactcttctgtctgatttttttccaacatagtatgcatgtttgacttaaatgaagtagaaatgcataattagttttgtctaatgtcttcacaaaagcccatgatatgatagtgttcctggaccaaactgaggattgggctgcttattcttgtggcccaataacgagatgcagatgaacgggaaaaggagagagtttttatttctgtaagtggttacagggagaagacctggaaattatccccagaccaactcaaaactataaagttttccagagcttatataccttctacgctgtatgtctacatgtaagtgtgtatccatctaaagacataaatgattaacttcttctgatctgtaactaagatctgattcctgaagacattcctctggagcctcagtaaatttactttatctaaatgggtccaggtgctgggatgattacccttatcttatctccggctaaatcatggagtttgggggagttccttcagatgcccagtaaacttgtttgtggagtcctggggagtttcttcagacccccaataaagcttttttaattctaaaagggtcctgttaagaattccttcattatcttgtcatgcttcaaggcccaggaaaggcctgggcaaaactcttggtgggcttttgttaccgtccagcctttgtttaagggcgctggctctatcagcttttaatatgtaactttaccactcagtcagtgctgaaacagttgttgtggaggcctgcattagtgagacctggcctgccacaatagttcatttacctcttcattgccgcaacatatatgtccacattaaaaatccaggactcaccctctttgggcaatatcatgtgataaaataaattgatatgacatacttcttgcaagatttctttttaatttaccttttagccagcatgataagcatgatgtagggtaaattaacactaaacttttgagtcagtaaggtagcctttctttttttaacttttattttaagttcaggggtacatgtgcaggtttgttatataggtaaacttgtgtcacgggggttggttgtacagattatttcatcacccagatattaggcctagtacccattaattatttttcctgatcctctccctcctcccaccctccaccttccgataagctccagtgtgtgttgttcccctctatgtgtccgtgtgttctcatcatttagctcccacctataagtgagaacatgcagtacttggttttctgttcctgcatcattttgctaaggataatggcctccaactccatccatgtccctgcaaaggacatgatctcattctttcttatggctacatagtattccatggtgtatatgtaccacattttcttggtccagtctatcattgacgggcatttgagttgattccacgtctttgctattgtaaatagtgctgcaatgaacatatgtatgcgtgtcttataatagaatgatttatatttctctgggtacatgcccagtaatgggattgctaggttgaatggtagttctgtttttagctctttgaggaatcactacactgacttccacaatggtttaactcatttactctcccaccaacagtgtataagtgttccattttctccgcagccccaccagcacgttattttttgataaagcaggcttcttcacactactctctaccttaggagaaaacgttatatccatactttaatttatttgaaaagaaaggtgaatataaaattgaaattctctgagtcttatttttcttatatgttcttgcctacttgtaacaaaacatataataaaagggcattataaatagtaaatcatataaacacaaaatattcccatttttgtcattatgtaatgtattttctgaattgaattgaaaaatgcatatatttatgaatttttttctactgaatctctccttcttatttacttctattcttttccatgatgttacctggtcttcttgagaacatgatattttaattgtaatcattgtgttcctaactccataatttcatgatgctattgaaatgcacatgaattttgattctataacctagtttgtaataagccatatttccttgtttctctacattggttgaatctgttcctgcagcaactagtaaccccaacaatctgactggtgagaaattcaatctccgtaacattttgcattcttctacttcttcccacttccattccaaagggccaggtagagtccagaatactgtaagtgtcctggttttcagtgcattttggtcatagctgatatgcttaatagccaagtaaacatgactacataaaggacagcttgtccacaatgccctgccttgcttgaacacggaaggttttgctgatgatgctctgtgcttggtatctggcctctacagccatttaagtaggttgtctcagcacaacatttggaaactctgtaaagggagtaggatgttggccttcacaacttcatccctttccctgtgtttgaggaagctcattaaacctctctttaatctgactgattgcaaatttccactgtccccgaatcttaactcccatatcccaatagcctgttcagttgggacaatatatcaatccttaacatgaatctagattttcagaactaaagtttttgaagggtgattttcctctggatacttgttcatttctttattgattatggttttggctaccttcttggcatcaaacagggaaaacagagcatttattcatgtgttactatcctattacactctgtatgccaattcatgtcctcaacacgtacacacaaacacacacacgcgcgtgcgcgcacacacacacacacatacatatacacacacccagtaaacatattctatatttaaaatgagcttagaagtttttaaaaaaggatgatactgggacaaagtggcaaaacattatttcagtgaaggaggtaacaatatatatgtacctttccattgtgtaagtgaattctaaatctgtatatagctaacacatttatatataactattgtgcaatgtgcctgctttaacagaagtaatcgagcagagctattgtgccatggaaggttttacatagatctaaaatggctcctgtgcccctggcttcctgtttgtttttatctgataataggaagaattaaatcattagagcagatgacgtacagtgaactatgtctctggatgctgatgagcagcctgcacaagactttggtaacaattgaattatttagtgcaattattttggagagatgaatattgatacaggaaacttacggaaatcctcgtttcagaaatagtgaggattgggaactttttgtttatgtataccatgatgttaataatcctactgaaaattatatgtatatggttagttgctccaataatcatatgatacaagtattcaagatgagtaaaatgtgaatttatgtggcttgctcacagtaaataggagagatgaagctaggacccaagaaaatggactctaaaactcatgatatttccatacctattattgttgggacaaaaattccacctacccaataatgcatttttgggacaaatcatcaaattgataagtcctatgagaagcaggcaggggggttggagacagtgaagactcaataacaggtggtattaaatgctcgcttactcacagaggatttaatctacctttgaatgtttagtaaccccaaaatgcaaccattgtttaggaagttttttagttgattctttctgaatgatttctaatacaaatgcccctcaacttgtgtggttaggtccctataaacccatcataagttgaaaatatcacaagtcaaaaatgcctttaatatacctaaccttcgaaacaacatagcttagcctaccctactttaaatgtgctggcttaacactatcctagagctgggcaaaatcatttcacacaaacctattttataataaagctagctcatgtaattgattgaatactgtactgaaagtgaaaaacagaatgcatgtatgggtactcaaaatacggtttctactaaatgagtatcaccttacactattataaggtcaaaatatcttaagtcgagaactgtttgtactttaaatgttaatattttttacatactgcgttttggtgagtgaagtaaacttagtttgcagtagagttatctaaagtgatattgtcattttcaaacattgctttttatttctactactcataaacaaattattgtgtttacatgattatttgaatattaacttaaaacagttttatacgaaattcaaaataccactttactggcatgtgaactccctaacatctacacttggtgttaagatgacttgtcgaatgatgtgtttgtgtttggaatcaagatgattatactaaatggtttaatctactgagaaccattcccttgaatgttttcctgaaacaatctttgcaaagtacctaagtaacaaaggatattactcagttagtgagacaaaaatggattgtgataggtctcactgttttcaaagaaagacaaatcacttattgttaatagtaaagaagtttcttagaaatatgttgctgtttatcaacccagtgttactgagatcttgacaattccttttagaaggtaaatgttttggtctctaggttatcatgtcctgatacaagaaaattggaattattgattacacctatattctctggagtggtctcagtgccaagcatatttagcttgcatatgtaaatatttaccaattagcatgatagttgctagcaaaaaaaccaattctttatggctgatgggcctatccattatttatctgattttattttgctttctagcaaaacaacatacatggacattagtgaagcatttttatttagaaaagaacaattgacactctggtaccatcctatcagagatatatgtttactaaaataacctttcaacatttaacaaatacttattgaatgccagctatgtgctaatcatactgtcatacagtgatgaaggcataacccaacatggttttccctctccaagagattatcatctgagaaaggaaacaattgcatcaacaaataattaaaataaaacataatctttaatgcaatagaaatgctgtgggaacatagaagacagaatgactaattgcttggagaggataatagctttttaaaatatggtgacatttagtctggtgttgtctacgcagagacaatttcaagaaagatgaaggcagaaggaattgcatgtagaaatgtgtaataatcaaagaagtatgacttgtcaggtgagtagtagcaagggagatctttaggagtgaagaagagaggttgtgagagggcatataatgccattcttgaagaattatattgttgtggggctggttgagccaacaataagataatggcttagtcatgttaatttgcaacttctgattgaagactgtgaagctctaaaacaacaggcaatgatagaagaattagactgccccaccaccactaatgcttcatgcaaaatttggtctgaagtctaccctttacatttggcaatagacatagagacctaaaatggaaaagcaagcaggctaccatttttgtagagttgtttgataccatgcacactccaaaacgatgcagcaaaacgcattggaattacctagaaaatgtgttaaaacatggattgctgaggcccatagtcagagtttctaattccataggtctagggtgggacccaggaatccggatttctaacaggtcctcaggtgatgctgatgctgacggccaaagaaccacactttgagaaccacagtgttagaatttcagtaatttaatcaggtctgtagtagagaatgttggaggaaaccccactgaggaatttattgaaccctcaaaggggaatgacctttttccagttgagaatcaatgcaagtacttgatttaaattgggatttattttgtggggactatactcaaaaactgaatgagttaaaagactcaaaatcaatcaatctgatactgattgagcattcttcgtccaaaacgtttgaaaatagaaatgtttcaaattttggattttcgtttggaatatttgcattatacttactggctgagcatctcaagtccaaaaatctgaaatccagaatgctccaatgagcatttcctttgtgtgtcatgtcagccctcaaaaggtttctgatttgggagcattttggatttgggatttttggatttgagaggctcaacctatacctattttttaaaaaatgtgtatatatatatatatggatatacatacacacatatatatgtacatatatacatatttatacacatatatgtacatatatacatatttacacacatatatgtacatatacacacatatttgtacatatatacacacatatgtacatatatacacacatatgtacatatacacacacatatgcatatatacatacacaaatatatgcatatatacatatacacacatgtatatatacacgtatatatacatatatacacacatgtgcacatatgtgcatatacatgtatatatacacatgtgcacatttgtgtatatatacacgtatatatacacatgtgtatatacacatgtacacacatatgtgtatatacacatacatacgtgtatatacacacatgtgtatacacacatatgtgtatatacacatacacacgtgtatatacacacatgtgtatacacacatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatgtgtgtatatacacatatacacacatatacacatatacgtatacacacatatgtgcatatacacatatacgtatacacatatacacgtatacacacatatgtgtatatacacatacacacatacacacatatgtgtatatacacatacacacatacacacatatgtgtatatacacatacacacatacacacatatgtgtatatacacatacacacatacacacatatgtgtatatacacatatacatatacacacatgtgtatacacatacacacatatgtgtatacacatacatacatatgtgtatacacatacatatacacacatgtgtatatacacatatacacacatatatacacgtgtatatacacatatacacatatacacacatgtgtatatacacgtgtatatacacatatacacatatacacacatgtgtatatacacatatacacacatacacatatgtgtatatatacacacatacacatatatgcacatgtgtatatatacacatatatgcacatatgtgtatatatacacatatatacatatatacgtatatatacacatatatatacatatatacgtatatatacacatatatatacatatatacgtatatatacacatatatatacatatatacgtatatatacacatatatgtatatgtgtgtatgcatatagacacatatacatatatacacacatgtgtatatatacgtgtgtatgtgtgtatatatacacacgtatatatacataagtgtatatacacatatgtatatatacgtatatatacgtgtgtatatatacatgtatatatacatatatgagtatgtgtatatatacacgtatatatacatatatgagtatgtgtatatatacacgtatacatatatgtgtatatatatacgtatacatttatgtgtatatatacgtatatatacgtatatatagttgttttaggttataagacttaaaaatacttatctgatgtatatatatatttttaacaatcctagttattttgtgtttcagggcagataggtgatgaataaagatattaatataattgtgttcaaaggttagaaaaaaacagttcgttgtggcattactattgactgtatccgcaaatttctttcactgcaatcctttcatgggctactatatatttttcttaagaataaaacatttccaattgacctacagagtctttcaatctctcttttgtgctttactttgcttcagcagaaggatttcattttagtgacactctgaaggtcttcctctgtgcttcacttaagggtgttgcatttttaaccttaccaagattcctatggattcctagaattatatttcaaattatgatcatggtagccagaacacaaagaattaagatctactctgacagtaatgtactgatataactttaactgtagaaacctttcttgtaatgcacatggagggcagacttgtatgtatcttggaacataaaaggcagagtatggtttttaaaagggctttgcttatttgtatcctaatttagctaatttcactatgccagttctatatgcagagataagtaatagtaaaaatggacaaaaagtgatcaataaacaagtgatcactttcggtcttgtccagaattgtggccaggtgatgagtgcaaactaagagaccttttcattagaaatgtgtgaagttactctttggtttagcattagctgtcttttaatgagaacaaatgagagttgcagatgaatttgctaaatgtttctttctttgatttagtttacctggcctgaagaaaaaaaaatgtcttcgatctacaaggtctacggagagtacttttcataggaactagtcctattaaaattacctgcagttattatgtcagtcagagaataaatattttgagtatcatatctgtacttgaagttcttatcctttacaaataatttatatttaaggaaacatgctttgacagaaatacacatgaagtctacattctctatctatttcatatcaggtgctctagtgttttgaatataacagttaagagatcaagtccctttaatcataaggccctgttagctagcgagctaaaccaaagagggaaacatttagcaaactatctgacgttctctatatttgtttgtcaacttgtttgttttttctctctgcaagtagaatatagaatttcagagagtgacaagtgctaagagaaaaaataaagcaggataagggtagaatagggatatttcaaagggtaggttgccattttatgtagtgggtcctggaaaagcctcacttaagaggcatacaaaaaacctgaaggaaggaaaggagggcatcttgcaggtgtcttggagaagagagttctaggcagagggaagaatatgtacactctgaggagggagtgcgtgtttgtgggataacaagggagtcaagatggctggtgcagagtgactgaggaagagcggtaggatctgcaagtggagtggtattagaaggacaaatcagatagggccttattgaccattgtaaaggtcttggcttgtacattgtgggagattaggagattttgagagttctgaacagtagccagaaataatgtaagttagaatgtaggatgtaaaggtagaagtagagagatgagttagaggataatgtagtaatgaaggctgggtgtgtgcgtgtggctaggattaggttgatgtccatggatctggggagaaatgatcgaattttggatacattttgaaagtagatgtaacaggatttgctggtggactaaaaatggagattgagagagtggagaaaaacagttttagcttgagcaaaaggaaggatgggatggttatttactgggataagaaagactattgcaagagagagtttggtggcaaagtataggtaaatttcccatggaaaatcattgaaaataattttagttttagtatgtttttatggaaggagtatttattttcaactcctaaaatttatcctcaagaacaagaataaatacatttatctctattaaaaaataaggaacaatgagagatgatacaagtgcctctagcattgtatgagtgtgtacaaccagtgaacgttaacttgtaaatccagtagcagtaacttgatctttgtctctcttctgatctgatagagtgcaaggtctatgtctacattcatttttttgcatgtagatgtccagttgtttcagcattatttgttgaaaaggctatctttgctccattctattgccattgctcgtttgtcaaagatcagtaaactgtattcatgtgggtctatttccacactattctgttctattgatgtatttgtctattattttgccaatacactgtcttgattactgtcatttcatagtaagtcttgtagtcagatagtgtcagttttccaactttgttcttctccttcaatattgtgtgggttattctgggtcttttgcctttcatataaactttagaaacggtttgtctatataaggcaaggtaacttgctgtgattttgattgggattgcgttaaatctgtagatcaacttgaggagaactgacttctttacaatattgagtctttctatccatgaacactgaatatttcaccattcatttagttcctctgataactttcatcagagttttgtagttttcttgtaaagatcttgtatattttttagatttattcctcagtattttatttttgaaaatgttagtggaaatggctttgtgttttacatttcaaattccacttgttcactgctggtgtgtaagaaacaattgaattttatatattaatcttgtgtcctgcaactttgctacaattgcttattatttccagggttatttttcgattctttcagattttctacatagatggtcatgtcatctatgaagaaatacagcttcatttctacattccaatagatatgtctattttctttgtcttattgcattagctaggacttccaatatgatgttgaaaaagagtggtaagagagacatttttgtcttgttcctgatcttcctgagaaagttttcattttctcaccactaaataggatgtcaattataggtgtttttgttcatttttttatattgtcatgaccttgttttataaaatacaattatttctctcctaactttctgtggacctcaattataattttcccataattctcttctgcttgcattgctcatgttttctgtcttcttcccatttgttcttatttgctttattttgaggaactgtttctcattattgaagtcattcctcaaattacaagtgatcttagcttttggtttatatttaagtgtgagatactaacatttgataaaattaaaatctatttcatgattaaagtacatttaatataaaacagaattgaataattttgttgacatattatatatatatatgcgtgtgtgtgtgtgtgtgtgtttgtgtgtgtgtaaagtccaaaagtttgtacattacttaaagaagaaacatctgatgcattctggataaagacaggaaaaccatatgagtactacagctacctccattaatacttaacattgtgttgaaaatattagccattgcaaccagacaagataaaccaattcgaggcaaaacaattgcaagcagtggtaatgggatcccaatttacagatagaattgtttacctcaagagatcacacaaaacaataatattaacaaacacaaatatgaacacaaacaaataccaataaaataatttagtaagttagcagactataaaatttacaggcaaaatcagtaaaattcattttataggtaatgagctagaagtttttatggatggtgcacacccatttgcaacaatagcaacaacagcaaaaacaagaaacacatttaacaagaaatttcagtacctatgtttaaaactctcctgaacaacccaaaaggaaatcaaggagaaagatgctccttgttcctgaaaagcatggcttaacattataaagtaaactattgtttttaagttaatgtgtaaattaaaggcattccaatataataagtagtatttttttctggagttggataaattgattataaactttttataaaaaaatacacaagtaaaaataaccagaaaaacactaaaaataaatatcgatgaagggatagggaaacataaaattataaattaaaacttagggaaaactatcatattaaatataaattttcaataaaaactaacaatttgttaaaatgtgttttgtaaaaatatatttctatcagctgggaaggtctggtagtaatgagtatacctagcatgcagatattcattggtaagtctcattccacactgaaagaagtcacagctcattagaagaatatatgatacttcatcctggccaaggaacatagtgggtgagcctgcagcctttgttagagccataaggcaaggaagtacttcccaaaatttgctaacatcttgagttgttcatttttcttctcctgttttctttatgcttgtagagttacacctttttaaaaggttttcttcctgtcattttattggaaaggcttcaaataatttttaaaacatatttatagatgttcatactcatatattttcctgatactgaaagagaaatttatgcatttagtaacaataaatgttggcctagattttctctgatggtctcttcaagaatctggagcgttctctatctccacaaaggatggaaatgtttcatttcaatatgccagttttcaagtaaatgtgatttagtttctctcttttaagaataaagtcatagcagaatgctttatattactgattgtagtatcataacttacttctgaaacatcgaatacaattttggaaggtcagcaatgtcctgttaatatttaagtatgcctcactatataatatgtgcatacattctggaagaagcatttaaaatgaagactgtttctaataatatattaaacgagctatgtaagtagagttttatgatagctgatattgtgattttattcagagactatttatataagacatttcagcatatctgctaaagaacaaacctatcatctaagtcagtaaaccaataatttgaattaaaaaaacggacaaaaagaaaatacgaagcaacttgaaagatcattaaatacactgcctgatagttaagattctaaacagttacattatatgaatagtttactgtatattatatattttctatttccactttgttataggtaagctaatcagatgtctcaagttataaaataatagcactaacttataaaagaagtgctacctttcttccactccccaaaatacacaagattttattcttcataaatgataacatttgttgtttgttttctgtggttgaaagggaagtacaggaatgaaataatgtattttgcaacaacttggatagaactggaggccattattctaagtaaagtaattcaggaatggaaaaccaaacaccgtatgttctcactcataagtgggagctcaactatgaggatgcaaaggcataagaatgatataatggactctagggactcagagcagggggaagggtaggagatgggtgagagataaaagcctacatattgggtacggtgtatacttctcaggtgatgggtgcaccaaaatctcggaaatcaccactaaagaacttacccaggtaaccaaaaaccacctgttcccccaaaagtattaaaataaaaaaatttaaaattttgaaaaattaggaaaaggaagtacattttcatgtgttgctctgttttagcacacctggtgcagaggtccctgaggaattttttctttttcttttttcttttttcttcttctttttttttttttttttttttttttcgagaaaaaaatatcacacatttgaggcaggagaatagggtctggaggaagggaacctaaggccatttcacgctgacttccctaggactaaactgaaggcaaaaccctaactttccacccctaagtaacataaggaccagaggctactccctttgcaaacctcccaccttttctgtgtagcagatgggaaattggctgttcccaaccaatcagactgattgcgggcccagtctttgcacagaagtgcaactttgtaacttcaccttagcctctgattggttgctttttgcaaccaatcagatgtttgcacaggagagtgtcctatgtaactctacttcagcctctgattggttgctttccacaaccaatcagaccaattgcaggccaccacttcatttacgtggggtgagcatgaagtggccaatgggaaacctgtagagggtatttggaccccagaagattttctttatctgggcacttgagccgctgctcagcccgctctcacactatggcatgtacttttcattttaaataaatcccttcattccttccttgctttgtttgtgcattttgtccaattctttgatcaagacaccaagaacctgggcaccctccactagtgacacactgataagatcttattatattgggctgataattcacctacacttttaccttctgaatagaaaaggcacttgattagagatgtatatatctaggtgctgggatcaactatgccatttgcaaagtaccttacttcttgagcaagaaggtaaccaaaaggggaatgaataggcaatataatttcttttaaaaatgaattagtaagctcttgtggttacaacaagaggactgttgttttggttctttcacaattttctatagtaaaatttgttagtattaaagtataatgttgatgcctatatttttaaaagatataaaagtagagattttaaaagagaattaaaaaggttttgagggaactgttttagattaagtaagataatgaagagaaacaatgcttaaaatattagaaaaaaagacttatgagaaaagtcagaagtactgaaactgtctagccaaagtagaaacgaaaccaaatgatacctttctcattcatattaattatttgaatgctttggttttgtttttctttattttatattctgttagacgctgtctttcttgtcttcaaccaattcttttctatgtaacattagacagtgtctaataataatacacaaaacaaaaaagttgtaaagaaaccacccacattttctcttcaaaagaaaaaattgtctgagaactctgaatgtctaaagtccttgaataataatgggaaatggaggatggttcatgagtgtttttcagtattagcaaaagactgacaaaagcatgagtttatcaacaggaagtacatatagtcagacttatagactgaaactgttcctaaagctgtgtgtccctgttttagaactatcaccacagtcactgaagccctgggcaattcacagacattgcaaaatcaccacagtccctgaaggccaaagaatgagacacaggagtcttttatcatttcataactcagtgtgcccattcttcctaataggcaggacccagcatctgtggtcctcaatacaaccatttagaaagtcacattgtagtcactccttttgcttgttctggcagggactgaagttggagcacaaaaaatcttgtaaaattcagttcctatatcagggtgtttccccctttttatcatgaagtcacatgtcccatcctgtgtcttaacagtaggtgattattagaagagtagctggcacacagtagatttataataaacaatggaataattagagtgcctagcgcacagtaaatttataataaaaaatatagaataattaatgatgaagaaatgaatggtagatgtagtagaatagaaagatatataggaatcctgagaagtttggcagcacatccaatagaaatgtattgcaaaaagtttatatagtatttacatttcttatagcctcatttaaaaactgagaagaaacaggtgaagtaattttaataatatttatttaactatatgtaaaacaaaaatattatttcttcaacaggtaatcactatatcaattagtattatttattgcattatttattgtaccacctctctaaattccgttgtgaattttacacttccagcaaatctcagcaacacgggatagccactattcaggtgctccaaagccacatgtggctagtggctaccacattacacagcatagctatagaggggtcttagaatattctgactaagtcaggaagggacttttgtcacctccaccaacatcccatgggtcagaacccagttatatggctaaacttaattgcaaaggaaactagaaaatgtaactatagaggaatctttaagaaactattggtcagacaacctaagtgtaatgtgacaggatattatctaaaatcttaatttgaaacaattacatatagttgatataaaatgcataaaatagagaaggatgtactatttttgaagccaggttcaaagtgtatataatgaacactattgaacaaagcaagatttaaaaaaaattgtgaattgaataaaatatgtatagtaaatgtacactctattatgtaaactaaagtatgtttagtataaaaacacccctatactaaaactcctttcaatactccaaagcagtaagaaaaaaaacacaaaatatacatttaccaatcttaatagtctagcttataaactgatatggaattcgttacatgatccctgtttgaacattatgtaagactagcccaggaaatgatatggaaaaaggaatgaaaggtaactttcaacgaagttacatgggagagtgatcaaaagaaaatgtgactttttttccttaactcaacacgtgtacgtgacgcttcaagtatgcaacaatggatctgtgctcaagtcaaatgcacagaccagaaacagaaattggtcagaagacatttcttgttttttcggttttttttttgttttttgtttttgtttttgtttttgtttttgagatggagtctcgctctgtcacccaggctggagtgcagtggcacactcttggctcactgcaacctccgactccctagttcaagcgattctcctgcctcagcctcctgagtagctgggactacaggcacgtgccaccacacccggctaatttttgtatttttagtagaggcggggtttcaccatgttagccaggatggctcaatctcctgacctcgtgatctgcccgcctcagcctcccaaagtgctgagattctgcgttggtcatcaatgtttaaacatgttaaacgtaacatgttacatttaagtaacaatacctacataatcatgtaagtacattcattgccaacttaaaagggagtcttcaaagcagaattgtcagaacttttagcttccctgggccacactgggagaattgtcttgggccacacattaaatacagtaacactaatgatagatgatgagctaaaaaaaataaatctaaaaaatatctcatgatgtttcaagaaagtttacaaatttgtgttgggctgcattcaaagctgtcctgggcctcatgcagcctgtaggctgcgggttggacaagcttgcttcaaagctaacattttttctccaaaattttccctactgctatcgcgatcaatttgtttcctctgaagtgactgattttaactgagatatttttgtttgtttgttttctggttctgcatgtataaatccttcgaatagtgtaaggacactgaatttccagcaacttctgtttcgaaggttcacacttcaaactataacatgttgtgtaattattggaaaagtgtcctaaagcttccattattagcctataaactatagttttggaagagactttgcccaccattttacattactagctgtgagtgcctaacatttagtaagtacccaagaaatatgaatgttagaataaagtcatacatataagaaattctttacattgttcaactactggagaatatgttatatgtagtgattatttttaaaagcattataaaaagcatttcaatttgttcaagcatctcaataagttagttaaaatacacagaaaatgaataaaacaattagaatatatatgtagcatttgtgtgtgtgtgtgtatataaacatatatatgcaaatgtgtgtgtgtgtgtatatatatatataaataggtagagaactttaaagtaattaaaatctgaatgtggttagctcaagtcaggtaaatttgagaaaatctttacaaaagccatttgctcatactactcactctcagattagttgttcatcaggtaaacaatttgctaaataaacatttaaataaaagaaacacattgcataggggaagaaaacataattttacctctaccttgattttttttttttttttttttttttttgacactgggtctcactttgtggcccaggctggagtgtggtaatgcaatcttgtctcactatagcttcaacctcccgggtttgagccatccttccacctcagcctccccggtagcttagctacaggcatgcaccaccatgccgggctaatttattattttttttactttttggagaaatgagggtcttgctatgttgccaaggctggtcttgaatgcttgagctcaagtgatccttcagtctcagcctcccaaagagctgggattacaggtgtgagccaccgcatctagcctctacctttatttcttaactgggactcctataacaaaagagatatcaacaagaaaaaaacaataaagtttactaacatacacacctcatgtatacatgaaagatatataaggaaaaatgaataaatttctctgacaaagaacaatacgttttttgagaagtaacaagacaagggaaaaggaccctgagtctctatgagtggccaatttcaggaaggcaaatatatgggaaactgatggtagataaaggctagttaagaaaatttattatgtagattcctctgatgcagtctccgggctgataaagatctaaagttgtcattggtgatcaaactttgtcctttctgatagagaggagaggatggacacctttgcaaatgtatgtactgttttcaggcaaatagtgggagggcagagaacttatatctgcttcttctgaattgcctttagctcaaaatagtcctgtgtcaaagtggcatattttcatgaacatagagaatggaataatagacattggagacttcaaaaggtgagaggggccgggtgcggtggctcacgcctataaccccagaactttgggaggctgaggcaggcagatcacgaggtcaggagttcgagaccagcctgaccaacatggttaaaccctgtctctactaaaaatacaaaaatcagtcgggcatggtggcgcgtgcctgtaatcccagctattcaggagaccgaggcaggagaattgattgaacccaggaggcggaggttgcagtgagccgagatcgcgccactgcactccagcctgggtgcacagggcgagactccatctcaaaaaaaaaaaaaatggcgggaggctctcatgtaccccagaaatttatacacctacagtgtacccacaaaaattaaaaatacaaaattttttaaaaggtgagattgtggcaggggagtgaggagtgagaaattacctattaggtacaatgtacactattggagtgatggtttcactagaagaccagacatcactactatccaacatatgcatgtaacaaaactacactgtacctcctaaatctataaaaataacaacagaaaaaggcaaatatacatatgctttcttatagattcattaatctgttttatttcagtgaatgaaaacttttgacaatggctaaccttgaaaatatgttattagaacatgtttttctttctccattgtgccctatgagcacaacttgagaaatccagcaataaaatgcaagctagtttttttttttttttgaaacagtcttgctctgtcgcccaaggtggagtgcaatggcactatctcggctcactgcaaccttcacctccagggttcaagcgattctcctgcctcggcctcccaggtagctgggactacaggtgtgtgccaccatgcctggctaattttttatttttggtagaggttttgccatgttggcccggctggtctcgaactcctgacctcaggtgacccgcccgcctctgcctcccaaagtgctgggattacaggcatgagccaccgcggccatcaagcctgctttcttgacatattttgtgacatattttgggatggcatatttcggtctcctacagttggcagggcaatctaaagtactttaatatccttcttcatgatactttcaaaaaatggaatttgatgcctcagaaaacaatactaaaactttcttaaaatattacaatgtgtactatattacttttttaagtaataggacttataaatatttatttttaaaatttgtaaatatttaccatccacctttgattgaacatttttttctcattattttatccaaaaatgtctattgagacctttaaaatttgtattttgtggcaccatctaagacgtgatttatgctccttgtcattatttaatcgtcaaaatgatactttgtctttgcttaaatcagtgtgggtacatcgaacaaggtttgagagctactctgtaggactgagtcattagcctgtaattttacagcggatcaagtactacgttttcattacttggaaagaaaatgaccttgcaattgactcttacatttaacgtttttatctcagctttaccaccattaaatataactgtttgcactgaccacataagaaaccagaaaaatcactgggtcacagtttaatctaattcaatttaaatccgagctagatagctataattggcagtttaccatatcaaaggccagagttaagttacactcaaaattgtgttgatttggaagtaatttgccttaaattttcaagcattgttctgggggtactaaaatgctctttcaagagtttactatatggtacgtaatattttccaagtgttagatgatttatgaagtctacattattatctaaaacaaccaatgttgtaactaccatacaagtctatgaatagaccttatttcacttggcctatctcagggtacaggatcccagccttcttccgtggcaatatgcaggctgttcctcagcaacgatttctagtattgtgtgaaataatcatacttacaatactaacttcttgcttcccaatgccaagaacactcatcttgtttctattgaataaggtgacaggcatgatagaagcagggcagagccaagtcctgacagtaacatttcaagtacagagaaattcatatgagaaaaatggacaatgagggcttgttgtccgtgactttttgttccatgaaaaatatgcctgttagcaaaatcacataactaggaattttagataaagtttctatgtacattatttaaaagagtgctttatacggcatttaagttaaaaagaaagaaaaaacattcacattaaacctaaaagtaactaaaaagtcatagaacagagatgtcatacagatggctagcctttattaagtgtcaagcattgttataatggatttgcatgagttctttaattgcatttatttatcttgttttggtttggtttttgagacaagatctcacttcgtcactcaggttggagtgcagtggagtcattgcggctcattgcagccttgacctccaagccatcctcctacctgaacccccaagtagctgggactacaggtgtcccccaccatgctcagctaatgttcctattttttgtagagatgggggtcccctatgttgcccaggctggtctcagactccatagctcaggtgatctacctgctttagcctctcaaagtgctggcgtgagccacggtgactgaccttatttatttatttttaatgaacaagtaacagttgagtaatttatggtgtacaatgtgatattttaatctatgaatatattacagaaacattcaatcaagctaattaacatatctatcacctcactaacttatgttttgtggtcagaatgttgtctactcttggtgggaatgtaaattagtatggtcattttggaaaataatatggagattcctcaaaaacctaaaaatggaattaccatatgatccaactttcctacttctggatatatatccaaaggtattttaattgatttgtcaaagatatatgtgcactctcagttaattcttaaagcaacgtactgagatagacattattagtatcctcattttacatatgacagaaccaaagcagagaatagttaaataacttgttcaaggctaaacggagaaagaatcaggattctttttaatattttcaagattcccaagttcaaatgattaaacaatctattttttttttttttttaaattgggggcttccaccttttttatatttgttgttagtgggatttaggacatatcatccccaaatatggcaccttggcatttcgggaaacagcggaagtgagaaagtctctgaccttctgccaccattttcctctgaagcagatcagaaaagaattatctggccttgctctgaagtaggccataagacccctcatgtgtcccatacctaaaggaaaggaatgtcacactgggacacagagaagactgaacaaacaggctttgctacattcccccccaccccaactttattaccattagattacacccttttgttctccaatcatacttctgccaggttgtccactcttcatcaaatttagcataaaaatacacaggtctcccctttttctttaggtattcatttctgaatgctcctgtgtcctggtatcatttgtaaaatttatattaaatacatttgtatgcttttctcttgttaacctttcttttgctataggggtctcagctatgaaccttgtgataggcgaggaaatcaattttttctcccctacattgttcacaatccaatttaagagaaaaagtgagcactcttgatgatccagtaccccccaaaacacacagacacatgcagaaataaaacaaaagttttataaaaggtggcatttttagtatatgtagccacactttaataattttatttcattcttttctatttgtttttttttttcctttttttgagatggagtctctgttgctcaggctggagtgcagtggcatgatatcagctcactgcaacctctgcctcctgggttcaagcaattctcctgccacagcctcccaagtagctgggactacaggcacacaccaccatgcctggctaattattgtattttagtagagacggggtttcaccgtgttgcccaggctggtcttgaactcctgaggtcaggcagtccgcccgcctcagcctcccaaagtgctaggattacaggcatgagcgaccgcaccagccttctatttgattttttacattaatggcagttatgacacataaacgggttgtacagctcacaaatgtcttgacctatagcttgaagagcatttgtctaaatgacttgctcaaactacttactcacaaatccgggttctaaagttaggttttttggtttaaaaactgtaggctttttcctcttggttttataattgtgtcagtccaaaaattcttcatttcctaacttttctccatattagctataaatcagaatagttgggaactaaatgggagctttgccaaaggggcaatccccaactacaatgcgttggtctaatattcagtaaaatacattgattttagtaaaattcactgcatattttgcattttactcaaattcaatataaaatagacagtttttttttttttttttttttgagacagagcttggcttttgttgcccaggctggagtgcaatggcgtggtcttggctcactgcaacctctgcctcctgggttcaagcgattgtccttcctcagcctcccaagtagttgggattacaggcacctgccaccatgcccagctaatttttgtattttagtagagacggggtttcaccatgttgaccaggctggtcttgaactcatgacctcaggtgatccgcccccatcggcctcccaaaatactgagattaccccacctggccaacagtctgttcttaaagaaagaaaattaaaataaatataattactagattcagtgtacattttacttttgtgagtatcattcaggaattcttacctcagaaaacctggaaaaggcaagttatttagaaatatgaagaaatcagggtgttttattcttaatgaaagcatgcatcttaatttatctttagaaatgactgggggaagttgattatacaatcaaaatgattaaaattaggcatgtagactttagtgcaagcaaatctgggccactcatttccaggtacatgaggaaatgtactagcacttcttttattactatagctttgaaggcagcgtgttgtcttacttcccattgtttggatttttaaactgataattaaattcatttgcatcactgctgcttggattacaaatacttaaaacaattagttttctgtcagatcacagatctacatcaaatagatgttactttttaaagaataagccctcaccaattagaatgattcaaaagcttttgattgttttctccaaattgttaagtatgcatttgtctttaatgtaaataaatagacttaatggcataaaaagccattctgaattttaaatgaatgacaaaatgtaaatcatgttctggcataatagttttgccaaagtttcaagaaaagaaataggagcattcacaataagcaattgcaagctgtgaaatggcatattaaaacagaggattaagttatttttctagttagtttttggggaaaaaatctccagtcttgcagaaatggctaaataattgcatttggtatggaggctacttttggtcaaaattatgttaataaatatctgagttcctcacattaaagtgaagcaagaatctgtggcatttttttaagtcataaaacatttgtatgttggcttttagatagtaacaagatggcatccatttatctgtatgcttctgcgcatacaaccttatatgacatatgtaccaataaaaaaagtatacatgtattagtaattaaattctagacttgtgctgtccaatttggtagccattagacaatggcaaaaaattattttgaatttaaattagtgaaagtaaaagaaactatgttgttcctccattttgctagctacatttgaagtgctcagtagtcacatggttttagtggccatcgtgttatgtagtgcatgtatagaacattttttgttttttatcaccaccaaaaattctaatggacaatgctggtttagctcttcagtattgcaaactttagcctttaaaagctatttgcaattatttagcgtgtattgtttatgctccaaaatactttcatctcaatgtagaaagaaaacgattgcacttttgaatataagagaaatcaaatccttgatttttttctacataaaaacgtggaatttaaactgaattatttaacaaaaatcaaagtaccttagaaataacctgaaaagaaaaacaaattttagataatatatataattttgaagtagaagaaaactaagataaaacgtactgcatttgtatacttttatagttttctaattattattataattggaaaaaatgaattttaacaaattaggtataattatcactgtggtaagcagtctccagaatggtcccaaattaaggttgtctgattacggaataccatgttcttttaagtccagtaatcccaaccttttctaggataaagcttggtatatggaatcaagatatgtattcttgttattcttctgttaccattactgctgtgggtttcaagaacaggcacatacagtttctccttgtgtgacacaaaccttgtgtgaatactttttggtacgctttcaaactggggcagcactagatgaatgccttttccctaggtatgcctttcagtaaactctccaggtgagaggggtgtagtaagtactgctttacatggatctaagtgacatgatttgatcacagttcaggtggttgtagttatgaaccatttcatgttaaattaaggtttaggggtttattttctaaaataatgctacttacagtgacagcatagcatagaatctacaagttctaaagcaactcaataacttctcttaaatggcccttattattttggattagcattttggatgacaactaactccactccctctcttgaagggaaagagatttggtagaaataattgaatgaatcctggattaatctagaatatgattttatcaatgactgatgaattacactgcactcagttgataacggtgtcttcttctcttagaaatgttgagtttgttcctattattatttcaggagacaaagctttttaaaagagttggtcaactgtagctaggcatgaaagcatggtctctaagaagacacttataattccctaagtatttgattaaaaggaaaacaagtacctcaaaaactcttaagtttatgttataggcaaagaagtccccaaacaatttagtcaacactctgaaataaactcttaagagtggtgattttcacttggcattttggagattccatgtgtggcaatgtgctcctcaatcaaggagttacatttctatgtgcagtaacattgcagttgcacaattaatacaaaaacaaacatatattaatcaatgacaggttttctcattttcatacagagttatgaaacctttaggctaaggaacagaatagtgagaaattagacaactattaataataggattaattagattctggccctacagctaagaaaatggagtgacaatcagaataacaccaaagttttgcaagttgtccaagtgacaaaatacaactaattaatactaataaactaaagtcaaattggactctatttacacaaagtactttttatatacaggcaaaaatttaagtagaaaaattatggcctcccagaactaataccaaaaatttaatggtaagaaaatgaacgtattcatttaatatataaccacatcatttgaaaatattgagctctcattgtaaagacatgacattttctctaaaattaatatattccataaaaatagtttttaaaagagaaaggctttgtcttcattcttttcgtgtgaaggtcaaatatcttagattggaatttaactgcaggaattatgcttctgttcttactttagcaacactaacgatgacattttctgaagtacatattgttaacaccatcatgatgaaagcaaatcatttttctacacttactttgatgctaatcagagcagtcatttaagttgctacatgactctgagacagaaatttcaaaatgaaattgaccaccgattcccagacaaaaccagaatagtggtgtcagatgagaagggttttgcagtgttttgtcacatttcattttgatttttacttttttctctgtttgacatatgttctgaactagagtgccataaagttttatcaccataagtttgaaatgaccacattactcatgagctacagagtcacaagtgagtttttagcttctttcaaagctgtagaaataaaactttatagtaccctaccctggtatatgttgttttatgtgacacattttgttccactttattcttttcttttatttcccttcattattttctttttgaattatagcagaatttgtattaaatttttcctaatacacaacagtttaagctacattttataatatcttatgtatttttttcatacagattatctttgacctgtaatgcccatctcttaaagaaattttagatggtcattataaacaaggttcattgtgaaatatatttctgttgaaacactgattttattacaaaaaggtaatgtttgatttccatgagaaccaaaactattggttgagatatgaaagatgaacatttgcttccctttacacaattgattaaaattcttaatgcatacatagtcacactacacaattagtgtagtacatacatatccgtataacttgagtcttccatgtatatgttatgcaatagaacttctacaaagacatcaatatctcatgctgaaactatccaaactataaaatgattttaggattagcttatcccaaagggaaattgtgagcaatgtggctggcctgacagcctgaagtgatatgctcagagtggatctgataggcagccattcatttcaagctcaggaagcaaacttattattttgtcatacacggtcgtttttccattgaagacattaagacggtaaagaaagtcctcagagtctatggaaaggatcaccagactttcattttatctccagatcttgaactggagcttttgaagattccattttagtgatttctggaaggctgctaatcttaatgaataaagtcagaaacacatgtgtgtggctgattcagattccagaaagaattttggttgctatcatgattatttttaaggcataagtgattaacgctgagatatactgcttttcctatttgtggattaaatttcttctatcggagaagttctaattgaaatgtctccattcaatgtggttgtgcacacacacaagtacacccatgaatgatattttacatatgtaaaaaaagaaaaccgatattaagtaacttctacttttcattatgagacatgctgtgtgtgattttatatatatatatacacatatatatgtatatatgattttcctgtgttttgttaatcattttttatcattttataatttttaccattttcatcattttttattgtgtggctgatatatactagatattactcactcagggaggatacaccctcatctgggcactcttttatacaagttatggcttttgttttaaataattcatctaagtttaatgaaagaaataagtgactgctttatcctagagaagcagcaaagagattttgttcacctgtgcctttagagactacatgacagcctctacaagtagcagggtagaatcaggttgattataaaagccttcatttcatgctaaatggaaaggagaaaagaaagaattttctcctttaattagaatgtggcagtttaatgacagaggcactattgttgtgggttaacatggaatgaaatcaattaaataggactatgtatacttaggtgtctgtaggaatcaccaaaaatgtaactctccaacagtttgctgaatctgcctctgttttgtctggctgctatacttggtatgtgggccatctggctcctggattccagtaaggtttgcatattcacacatcaatcagaagtggtgtagggcctattaggaagcaccagccagttaggtgacatgccaggactgcaaagcactcaagcaggaatgccaagtggggagcttctgctgaagctgacgctgacacgggcattggaggcaccttttgatccgtctagctttactgttgatgtcacagtcctgctagatcaggcatagggatgtcaggtcacgtaaggcctcatttatgtcattggttttgcctggataattcaaatggagcaaaaataaaagtgatcttgatccttaggtcccatgacttttgatagtagaaggatcattgatctgaaattgtcttgcattcctgactagtagacagaaagatatcagaagcaactttgtctattctgtttctagaactatattgtgggtactagtttttcacagtagtactagacatttcagaaacagctaccgaataatctttccaaataaagggaaaggttgtaataaaatgcattcccattccctatgtcttctcaaacagttcactgaaacttaaagggatgagcacactttacaagaaatgcaaataaccttttagttcactgaaataagataaacaacacatgtgtgtatttttaattggaagctctatcattcagttccttgaactaacagctactatacttttcttttgatgtatgcttcacagatatccattgcaagttttagattgtttgcttcaatgtagataagacaaattaactgaaaacttaaaaagcacctagaggattggttattttaatgttttttagacctctggatgctttgatcccatacagaataggatgaaattccactataatggcattgttttaaaatttgaattggccgtaatgtgttgtgtgtgcacacatttatctagctatgaacacaattaatactcactgagagagctctttaaaatgatgacataatttttttctttgaaaagttatttcttacgccctaaatttctaaagtcaccaaaaaaaggtaattttctatatgtaagacttatttatagtaactaaatttctaagtaactgatatctcctaaacagaaatgtctaataacttacttctagatcagctttaacaatggttttgatttatctaacttagtgcagtaatacaaatattagtagtaaaataatacaagtttaactaacttggtataataataggaataatataattgctcatgtttgatgtatgctaactacttggcaccattaagtacatcacatgtattatttcacttttctcattaaaatagcagtgtgatgctattatctccattttacagagagggaaagtgaggcatggagagaagtcgcaatttagaaaagtaataagtataatacttattttaattttaaattattctttgctagaggaaagatgcatgttccttggacatcttctatactttaataatattatttctatgtttctagcaacccccacaatgaaaagcaaatacacgatgcctttgggggacaaagcagttctgtagtcaggcccacacatgaagtgttttacctttataggtttcaacaattaattggaataagctattttttctgttttggcatctgtctacttggcaaggcccccaactgtggtgttggcagctgcatgacagcgactgcctctggtttttccacagcaactggctgaaactcgcctccctgggctgtcctattatgttgaaaattattttctttgactcaaatcagaagagtgtaatagaaattgtgaaaattcctgacatcttcccaaagatgtttttgaaataggttaaggttctccgggagtaaacttggattctaaatatgattttttttttctgacagatgtatgcatgtgttatggtaggtattcagaaatgaatgctctcatttgtaaaataaaataaaataatcccaaactcttaactatagcaatttgtggttttaatcgttttcccttgtaaatggaaacttggtaagttttagagtgcattgtacatgataaaatacatcttatgtctaaaatcttagaaaatattatcttgcattggggaaaacatcataatagtgcatatgtgattcattttatgtaaagtcctaaaattatctaaattaaaatatctatattctatagctgtgcatgtgtgtatgcacacacaagaatatacacatctgcattttatatagatacaagtatattgaaaggatgatacattcttatacagatgtagagcttaggatttctttatcaatataagatagaaactgcgaaagcatgaaaatgaaattaagcatacttcctttattcacttatcacccgttttcagaattagttgccctatgggtaggtaccttttaaattatattgtacatctttcaattaaatatcgggaggttgaaaattaagtgacaattctaatatttctagtggaagacctgaagctgcactattaaaaagctagtaaatggaaggggaaggatatttctttatccatggagttaattacacaagcagtacactatgtaagtgctaggagaaaaggtgatacaaacactacttaaaaggtttccagcgagaagcagctctgaacaaagtagatttaaagtgttacctccttactcctacaaattctaatgggaatcaattatgttccatgagtaataataataattaatatttatggaagtgcttactatatgcttggctctgaaataagggcttcacatattatagcacataactatcctaagtagaagatactatttttacttccctttttatagatagggaaagtaaaacacagaggtgggccgggcacggtggctcactcctacaatcccagcactttgggcggccaaagcgggtggatcacctgaggtcaagagtttgagaccagcctggccaacatgacaaaaccctgtctctactaaaaatacaaaaattagccgggtgtggtggtgggtgcctgtaatcccagctacttgggaggctgaggcaggagaatcgcttgaacctgggaggcggaagttgcagtgagccgagatggcgccattgcgctccagcctggggaacaggaaggaaactccatctcaaataagtaaataaataaatagcacagaggttaaataactctcctacactcacacactccatgtgtctctggtgatcacttggtaccacttcttttcttgcatgtctcacctctcttataaacacattaccaattttaaatgggtgttatgaactatgtgtattaattatggctgagaaccaccatttttaataacatggaattttctttagctggcagggaaggaatgcttccagtttaaaaaaaacggtaaaggacatagctttaaacagaaaagacgctttgaagataagttcatgtccataaagtccattcaaataacttagtaaattgctgataaggtcatatcatgtagcattttttaaaaataagattgctgaaagttcagcttgctctgagtaaacacagagcaagatgattctcaattatatagtgaataaaatcaataagaacatctagtgaaatccaaacagaaaataaaaaaatcaaaattgacttttaaaaaaattgacattttatggagataattgtagatacatatacagttaataagaaataatacggatatcctatgtacactttaccattttttccctaaagttaatattttgcaaaactataatataatatcacagccagaatattgacattactacaattcagcaattttattcagtttctctcggtgttcctatatgtgtgtgtgtgtgtgtgtgtgtgtgtgtgtgtgtgtgtgtgtgtgtatttagttctgtacagtttcatcacatgtgcaggtgtaggggaattggatatcacctccaatcccccttttagttcttagtaggctcttcagttggatctagaaaccaaatcgacatcaggcagaaaacaaaagaaaagaatacaaattgtattacttatacatgtacgtggagatcatcacaagaaagtgaagcctgaagaagtagtcaaagcaagatgcttttaatgatgaatgatgaatttgatgaatttggaaagcaatgacaggataaagagaatctggctagggacagtaaattttctctaggggagtcactaggagatagatagtgggtataaaactagtgaaagataagggttacttcagtaaatatatttattcaggtccattgaagcctccaattctaagtctctggtaataagggctattttctcactctggtcctgtgagggtgcccctcccagaggaatctttatggtttgctgcatgtaggaagagacaggtgagctaactctttctgaaactacaatttctccaaagtttccaactgaaaatagccaacataccaatctggcatatttggggatggaacatcctttactccttcacaggtatctgtggatgagagctgaagcaggcccaccaggaacagagagtgtttccccttactgttggcaattctctggattgcatctacccatcctgtcctagaaagtgtcaggagaacctgatgttgtctcagggaatcctcttagatgtggagagataagcctttctaggctgctttcgactgctggttgtgggtctcgaaatggtgagtctgggtcacttgcttctattaagtgaaaagatgtaagtcactcaacttctgctccagacccagtaaaccaaaactccgtcgtcttcttctgactaccttcagagttatcttgggtttattcctgcattattaccagcatttgttgctgttttagtgggaagaggaagggaaaaatgggtcgaagttatcttacccttaccagaagttcctaaatagactttttcatgagaaagaatatttttaaaaaactgtttatattataaatattcttggtagtttttttgctgttacatattttttaaaaatccatagtgcagatataataaaaactattgcaggtatttaaattaacagaactagttgaattcctacaacgtgtcatgtacagtgctaggttggttgatctgtctgtgcttctgctttacttggaatggatgagcaaaggcttatactaatttgcacttagtattataatgaggtgtgagaaaccaattttcatattcaagtgtctataaaaagtgactatttttcaacagttagctcctttaattataaaatcagtttttattaaaggcagttgatgctttgtgtgttgttgctagggtgacatatattatagaaacatacagtttatctttccagtaagagggaatacagtctctatcttaccgttaatactttaattagagaatgatcgacagaaaaatcttttttctcttcatgagatttgaaaaatgcatatcttctttatctgcatttaatcaaccctgggttcattaggatttgttgtgttggcacctgagaacatcttagaaattattaaataattcattttctgctttttttctttattttttatttccagcagaggcttgtattaaggagattctcttttgacatacccccacatacattcacactaatatatatgcactattttcaactgacatgttttagagttattgagatattaattttataggatactatcacattttatagctcttagtaaatagtatggtatttcaaaacataatttagttatagtaatagaaataatccatcatatttgttgtatttataaaatgtcttcaaaaatatcatataaatgatatctgaaattttgtcctagtcttgcaaatgctaggggattaatattaataaggttgttgtcaatataaatttctagtgagatgctcattaactggaaatccagtgctagagagacatttcagaatacctaaaccttatttagagacaaataaacatactagttaatatggctattgctatgaaccgcataaaattgaaatttgcccgaactcattcagctaagcatgctaacctcggctttggaaaagattgaatggcctatcatcagtcaatcttggtactagagttaaaagaagaggcaagtaatatggacagcacaaggaaaatgacagaaatagcggcttgtgatgataattagcaagaagtttgaataagcaaactctaaagaatattgaaaatgagacaaaaactgttaatgtatatgcaattaaatctttggaccctccttgcttgttgtttcaaatatccaattgtggagagaactacgctagggtaataatattgcccgttttccctgtccctccatgtactccaattaagaaagcagaaatgaaccatctaccctgatttttggaggaggaattgagtaggtatggcttcatgctctttaaattggggttaagcccccatgatataaattatatagggaatgcttcttcttccatttaatgcttactaatggatgtcactaggcaaattattagcaaacatacataataagaagacttaatgctatgttcgctgataacagctttatcattagtaaaggagatattttcatctctattcgtctgactcctatatgtgcggcttaattgattacgaacctaggtggggaatagatttaataattttctcaaactccatctataagtaatatgaagacatgataaatttttaagcagaaaaatgaaatgaaaaatattatgattcggaaaatttgtttccttgtactatgaaggatacttgggagcaggttggagaagagggtgaaggaaccgtttgggggacgcgtcagtaaaactggtggtagagactaggctgaaggatgatagtgggaatggaaaagtgaagacatttgaagggaagaagacattgtgtcggagttctaacgatgttcatttgtgcataaaacttgcatttgtctatcttattgtactttatatattcttcctaataccctgtactccattttactcctttttttttttttttttttttttttgagacagagtctggctctgtcgcccaagcaggagtggtgcagtggcgcgatctcggttcactgcaacctccgcctcctgggttcaagcattcctcgcgcctcagcctcccgagtagctgggattacaggcgcctgctactacaccagcctaatttttctgtttttagtagagacggagtttcaccacgttggccaggctggtctcaaactcctgacctcaagtgatctgcccgcctcggcctcccaaagtgctgggattacaggcgtgaaccacctcgcctggcccctgtaccccattttcaatatggcaaatggaataaatgtttttacaacatttatttgactgttgtttataactcttcaatagctgtccattactgtaaagtttatgccacaacctatagggctctaccttttaacagctatctctttctgattttccacttctctccaacctccctccctaaattacggtgatactgattttcttttaaaatacaggactactatcagcctcctttttcatcttttaggccacaacttaatgtttcttcctcagagaaatttctaaaggacccaaacccacaatagcttctatatgagactacttctcccattatatatcttccaggtatcctgtaatctcctttacaacagccagcagaattgaagtacactatttgtcaaccaaaggtgtgaagcttcttcttactcctggtgtttgtggttttattgactcttctttgttttctttaccagtgagatcccatctacatctttcagtattttcaccagtatcttggtcttttgcttgcttgctttcttgttttctaggttgattataattttattcctctaaacacatgaataccttccgtcattccaatggaattttggacaaaagggaaaaagttataagtgccaatttggttgccatgaaccaaaacagaaaattaaatacaattgcctagataatcaggcccaatttgtattacctagtatgaaaaacactttggtaacaacagtaggtcatgttaaactaattaatttctaggaacattgataaattaaacattggttactctccagagtaactctaagcccagaaaataagtgacttgtacatccatcatctgattcaggttcaaagagagtttctttattttggcaaagccaactttactgaaatgagatgagaagatttctgttgccaatttataatggagattaaaaataagaccccattgtcagagttggagatcatatgttggtaattgtggttttgtacaaaattaagaattgatccctaagaacttgtaaattataaagactttgtttagctcagtcacatttgcctaatctaagatttctgtctaggagaaataattttctagatggagtcaactagtacacctagtttaagtcttctttatgtgagattgtgtttaaaacagtgactcttttggccatagttacaatgagttcttcaagggttgtgtatttgcagactatcagtggaaagcacttgaatggcaatagttggaaattttgaagcaaaggaaataaaattgttacttgaaaccttgtaaaaagatcatacggccgggcgcagtgtctcatgcctgtaatcccagcactttgggaggcccagacaggtggatcatttgaggtcaggagttggagaccaacctggccaacatggtgaaacccgtctctactaaaaatataaaaattagttcagtgtaatggcgcacgcctgtaatcccagctactcaggaggctgaggtgggggaatcacttgagcctgggaggcggaggttgcatcgagccgagattgcaccactgcactccaatctgggtgagagagtgagaccctgtctcaaaaaaaaagataaatttttaaaaatccatgcaaagagcttgctattttgctattttagggagggagcatgagcttcatactcacttggaatttcctgagataaaggcagaaatagaattggaaaatatttaatataaatctgaaaagataaggcatttctcttagaagaagtttctaagcaaggcagctatatagcaaagggtgaggtatatatccctggctgcctcttagcacagggaactggcaccacggggcctacactggcccaagagttcttcaaagataattgtgttcccacaacttttctctgtgtagtaaactcttcctgccctgtagcagtccgcccagttcatgaaaaccatgggatttgacccactgaagaagacttttctcttaaagtttttcctgtttatccaggttttacccagtaaaggtcagctataactggtaatagttttgtcaatgtttccataccttgggacaaagttccttatttgctcggtatttcctctcaagttttacttggcattttgaaatttgaaaaaaattctatgtttttcctggctgtgaaaatgtattttttctttagtatttgatattcaatttataaaataagacttaaagcagctagatatttgcccatcgttatgtttagtggaatgaagaactaatcagctactactagtcttgttccaattaacattctattcctccatttccttcccacactgatatatgtacatatatagatatcagtgtgatatatatatatatcacacatacatatgctcatatatacatatatatcttatataagtctttgacctttctaagggtcaaacaccatgtttttcacaatctaggcaagctgctacaaggaaggaagagtctattatacacagaaaagctgcaggagcacaattatctttgacaatacaccttatattggtattttattttttttctgaaattactctgggttgagtcttatatttagtttctaattgtgaaggaaagccctgtaatgacctggtgatccatcttctttagaaccaagtcggccacagtcctaaaataaacatctgaaggcataggaacatttacagatgaaaatcataatttaatcaattgggtgtattatcttattttctaaatatgtatacattatttctttttttcttttttgtgagatggagtcttgctctgtcactcaggctggagtgcagtggcatgatctcggctcaatgcaacctccgcctcctgggttcaagcgattctcctgtctcaacctcctgagcagctgggactataggggtgtgccaccatgcccggttaatttttgtatttttattgtaacagtggagatggggttttgccacgttggccaggctggtctcaaactcctgacctcaagcgatccgccccaccttggactcccaatgtgttgggattacaggtgtgagccaccacgccaggctaccgtgtttcttttaaaaactttttttcttctatgtaccgtataggttttaaccctgtaagactgaacaccctcttttgtaagacatattttgtaatactcccattactatcctcaaagagaatttaccaaaaatgtaacttacatatatatataaaattctaaaacaattaccttgtaaaaaataaatcaaaggacaataatgaattaaaaataatggatatatttatcatcaataattaattattcaatatgaaaataagaaaggtacatactgctctagataaatgtagtacctgtacctaaaaccacagaagtagacagctcgaaatgctgacgtatgcaggtgagtggtatgaatgattaaaatgccatgaacagcatattttaaagtaatgggatttttctgtatgattaataacatttggtaaagttctgaataaaataagtgcacattttccctttgatttattgtgggatagtttcattcttggaaaatgcagtgcatataaagactttgtatttatatgtaaaattgagctaggttctatatattcacatacttataaacaggctgtcccctacttttcaaaagctgaataggacatgaaacaattactcattttcctggactttcctgcgtgttactggatgtctggcgtccttagagcacctttccatccgttatggggacaatcacagtgctttcacgtttcttaaatgtacccagggtatggtggtgtgcccagttgagaggaactgcaagtgagggttgtatttttttttttttgagacgagtctcgttctattaccaaagctggagtgcagaggcgcgatctcaattcactgcaacctccgcctcccagcttcaagcgattctcctgcctcagcctcccgagtagctgggattacaggcttgcgccaccacacccagctaatttttgtatttttagtagagatggggtttcaccatgttggccagactggtcacaaacttctgacctcaaatgatccacctacctcggcctcccaaagtgctaggattacaagcatgagccaccgtgccaggccagggattgcatttttgcatcgaagtagcagaaactagaaccagaggattttaactttctcatatgatggaatctgaaggaatggagtctaaagcaagaaactggccctgtgatggcatgaaaatcccaggcccctttgatcttcttgctcttttacaccttactatcattctcatgcttgtcaactcttggttgcaagatgatggtttcaacatctccagcctcaagtcttacatttcagagcagaaagatgaaaaaggaagcaagaagaaggaagaggcagcatgtacatcaggaaaacaaaactatcccagaaatccctagctgtcgtcctctcagatgccaaaaggccatgactgggtgccagagatgcttgaaatagagctctttgttcttgcttgacaccttgctacttctaaacaaaatcacgattttgttgttgagagaaaaaggactcctccctatctacttgtcctgagactgcttcagcctctcagcttcctagaccctcatgcagttgatttccaattcttccaggagctggcttactgtctactttttcagggtttcaaaaaaaaaaaaaaaaaaaaaaagcattttttaaagtttaaaaagcaaaatgtggagtgaatattttttggttactatgctttttaaatttttagaatttgtttttactgtgggttggctgttaatagtccatcaagacaactatttctttgctgggtttattggatattgggcaagcaaacaagcaaatagcagtatctgccactggatgtaatcaggaagaaattttcagaaaaaaaaaatgatgcttcaaggtctagataagcagattttccactggttcctgattattctaaataaaatgtttagtcagtggttgtgtaagtttcaaggatgttatagatggctcttgaaaacaataacacattaacctaatattttcagtactcctttttctagcttcatttatcctctcccatgcctgtaaacatgttactttgttaaccaaataaagtcattaatacatgagaccattttgccaaaagtaaacttaaaattaggaggaattggtctttcagaaggcaagaagagaccaagatgaaaggaagtcatttttgtgaaccatatgttttgacccagaagaactatttcacagcctttctcctggtagcaaacaatgagggaaacagtttcttaccatctgcacaataaaacttgttgaatcactcgggaattgggattattgctactgtttgtttgttgttaagccttaaatttaaaaaaagacaggatatataagcagggttggttctaatactgaaataaaacaaaaatgaacaaacccagagaaatctgcttccaaaaagccacagcacaacaaaaagaggtgtaaacatcagaagacctcaagggaaaaatacgtttatttagaaatgggatatcctggggattttgttacagcagctttattaagatattattcacatactgtaaaattcactctctagaagtgtacaattcagtgttttttcagtatgttcacagagctatgcaactatcatcactatctagttgcagaatactttcatcatccccaaaagaaactgtatgcccattagcagtcactccccattcctctctccctctagcctctggcaaccgctactctgtgttgtgtctctatagatctgcctattttggacatttcatataaatggaatcatactatatgtggcctctagtgtctgtaatctttcattttgcataatgtttttaaggtccattcatattgtagaatgtatcagtctttcattccttttatttgctaaataaaatttcattgtatggatataccaaattttgtttgtccatttatcaccagtttacgggtattcgtaaggcttttttttcccactttttgcttccagtagactttttgtatgtcacaaatggccatatgtttctttatcccataatcagaataaaaattatcattcttttagtggacgtgcctttttttaatcaaggcacagaaataaaaaagtgagttgtattttctcattaagaaaacattttggggtgtgcatgttttcagttgtttggaaatatgtagacatattggcagggtatcccacttacttttgctgtgtataaaatcaccctgatacttagcagtttaaaacaattactttattatgccgtggatgctgtgagtaataaattcagataggacacagcagggatgttctgtttatgctctgcaatatctatagcctcatctgtcaagacttgaaagctaagttggactcaatggctggagggtggaattctgaaggcctacatgtgaacttgctatgttgtttggcttcttcctagcatggtggctttacgatactcacacattttctatggtaactcagggttccaagcaaacgctgttctagcaaacaaggtagtagtcatatggtcttttatgaccctgccatggagggcacaaaacattactcttgccatcctctatctgttgaagtagttacaaactcacccagattgaagaggaaaggacatagaccctacctttccatttgccaatgagttttgggaccatattttaaaaccattgtgccataaagggcatgttttatgacaggtgaagctttacgtcttaaaagtatataattacaaatgattaaatttaaaatcacgagaataaaccattgcattcatctaccatcttgccactaaatcagaatcagtaaaacaaggtcaaattgactagaagccacatatagttgacatttggaagaatttgacagaaatatggctcaattggagttactgaatttaaaccaaaacgtttggcaccaagaatcatgggagcccagactaaagaggaaacatacattatatagctcttattatctaatggtgaaaatcctatcaaatctccacaaaggtggtgaactctggtcttccatggcatcctagacaaactttatttacaggcatgtatggtatataaaataggcatagataataaatataataatccagaacaatgataaaacagctactatgtcaaggtaccatcctaacctcacttataatcaggcattaaattctcataagaatcctatgaattagacaccattattatccatatttaacatatggaaagaaactaaagtacggagatgctaatgaacttacccatcgtcccactaataaatgttaaagtcaggatttgaacctagatgctcaggctccaaagcctatgctcaaaactcttgctatgtgaatactggcatattactgaataaaatagccccagttttgtttttaaataaaaaatgttgatcaatttttttcaataaaatattgtttcatcacaataagacctacttattttcctcctgagcagtttttagtgacatcaataacaatttttttaggctgggcacagtggctcatgcctgtaatcccagcactttaggaggccaaggtgggcagatcacttgagctcaggagtttgaggcaagccagggtaacatggcaaaacctcacctctataaaaaaaatacaaaaattaacagagcgtcgtggtgcatgcctgtattcccagctacttgggaggctgaggtaggaggatctcttgagcccgggaggtcaaggctgcagtgagccatcattgcaccatcgcactccagcctgggctacagagcaagaccctatcttaaaaaaaaccaaaaaaattataagcgagtcatacaagttcttcacagcttttcattatggtaaaccttgattaaaagccaaggttataaatgtaatttttgctaagtgcggatgtattgtatctgtagcaaactgtaattcaggcccctgaatgtaacatcctagctctcattccttttgctgtcagatttccctatagataacgtctacatctgctaccttatctactcgcaaatatttatgattttcttccatgaaatttacttttctcccctgaacctgtaagccaaatcaagtgaccttttgtgaatctcaaacctctgtgaattttaggtagatttaatattcttggccaccactttctattcagtcaaattcaagaattctataaagttaaatatatatggatgtgtgcacacatatatatatatgtgtgtgtctctaggtcatgaatcttttaatactatagaacatagaacatagaaaattataagagaaattaaaatatattgtcaatttaaaagcataccgaaaacatgttatatgagaatggaataatacaaattattggtatggggagaagaatcatgaatagtttcatgaggaatgtggcatgtgtaacaggcattaaatatgattaagaactaacactgagtatatacaagttagctgtatcaataaaaatgtaaatcattcagcaataaactataaagttatttttactccataagggtttttttccctgaaattttcggcccaaagtgactgttttttcttcacatgccacttatatagtgtgaccaagtatttagttaaaaaaattattctccagtcaaatcatttgttgtacacttcttggagctgtggcttgcttgtgtttttattgattaaaaaatacagcacaatcttgcacctaataaaaacctaacaaactggctgagtgcggtggctcacgcttgtaatcccagcactttgggaggccaaggcaagcggatgactggaagtcaagagttcaagaccagcctggccaacatggtgaaaccccatctctactaaaaatacaaaaattagcctgacctggtggcaggcatctgtaatcccagctactcaggaggctgaggcaggagaatcacttgaacccgggaggcagaggttgccatgagccgaaattgcgccactgcactccagcctgggcaacaagagtgaacctctgtctcaaaaaggaaaaaacaacaacaataacagaagaaacccagtaaataataggaaaaaagtgaatatagaaaagtaatagaaaatggttgcctttgtgaggttagatgtaaccaaaatattttagcaattgtttagaacaaatagattaaatgaaaaatatttccattaatattttaaactgttaaattctgtctaatttcacatggtagatacacattcattaagacttttcagtgttaagactaaataaagaaaaagaaaattcttcttattgtgccttattcagaatccactgaatttcgttattatttttattatcattatcattatcattatcagtattatttgagatggagtctcgctctgtcacccaggctggagtgcagtggcgccatcttggctcactgcaacctccgcctcccgggttcaagcgattctcctgcctcagcctcctggggagctaggattacaggtgtgcgccaccatgtccagctaatttttgtatttttagtatcttatttttgtgggtacacaatagatatatatatttatggggtacatgagatgttttgatacagacatgcaatgtgaaataatcacatcatggagaatgggatatacacccctcaagcatttatccttcatgttacaagcaatccaattacactcttttagttatttttaaatttacaattaagttattattgactatacttaccctgttgtgctatcaaataggtcttattctttagcaaagcatatttgtaaagagtttggagtttctctttgctttacacactgtaaaaaaaaatgtcaaacaaggttatccaaagagtagtaggagaatgagcattgagatcataagtgtctcatctgatcaaagttattcaagaatgaatgcattttggaggcaagagttgaggaccatcgccatcattgactatggagtaacacaagcccagactcttgagattaatttggcattatctttcaaaattaaaagtataattacatatttacatagcaattctacttcaaggagtttgcccttcatttatgttttcacatgagtaagggtttagatggacatgggttttctttgtagctaggtaatagtaaaataggtaatctaaatggacatagcttggtggtagtccatgcctgtgccctttatactacagttttaaacaagagatgaatttatataaacagatgttgaaatgtgatcgttatgtagtattaattgcacaaaagtagaacatatatatgtgcatatgtatgcatacatacatgtacatacatatgtgcatatgtgttctagtttattatatatatgtcaaattgttctatttgtatgaaaacactataaatacatacataataaataaacaaatatgcgtttgtgccaaaaagcacagaacatttctgtttagtctcataccactcattttatagctttatagataggaagaaggtagactttgatggtacttgaatttttatctatgtatctgggcaagtattttatctatgtatgtggtagcatattttatctatgtatgtggtacatacatgttttatgtatatgtatgtatacatgcatatatgtatgtataaaatacatacatattttatctatgtatgtggtagcacgtgagagaatttttgttaatttatatgttatttcacttcaaaaattgataaactgtgtgtgtgtacatatatgggtggtggctatatacatatagatattatatttctgggtggtttataaagagcagaaatgtgttgctcctagttctagaggctggtgagtccaaaagtcaccagcatgttaggtgtcttgtgagcccgcttcctcagtgacgttcatcttgttgatgattcctcacatggtggaggggaaagggagcgttctaggttctttttttttttttttttttttttttttttgagacagaatctcattctgtctcccaggctggagggcagtggcacgatcttggctcactgcaacctctgcctccgggtttcaagcaattctctgcctcagcctcccaagtagctgggattataggcacccaccaccacgcctggctaattttttgtatttttagtagaggtggggtttcaccattttggccaggctggtcttgaactcctgacctcgtgatccacccaccctggcctcccaaagtgctgggattacaggtgtgagccaccgcgcctggcctgtaggttctcttttacgaggcaactaattccaataatgagagctccatcctcgtgacctaatcacctcccaaaaagccccaaacccatctcctaatactatcactttgggagttaggatttcaacatatgaattttgggtggacacaaacattcattcaataacagtgactatactatcctatgttaacattttactattttcaaagcttttgttcactttgtatatatgcatttatttatctttgtagcaaatgaaggataaaaatatcttttggagtattatcttgacatactctccagctgctagggatgacctgtcagtattgaccccttgggctgaagcaattcgatcctctcaaaactcaaattgaagtgagaactatctcttctcctttatttcctttcaccagaaatagctatttcatgttttaaaacaactggaaggtaactgaaaactttcagtggtgttaaatcactgtcagaaaaaaaaaaaaaatctgtttgaaagttggaaacagctcaagtaaagccatttaatctgaccagcataagcagattctgaagaaaatggtgaagaatatcattagcagcaatgcacacagtcatttattcattcaacagatgaacatttgatgaacacttactggttcttggggactatactccatgcctaaaatacaaagatgaacgaagacccaattcttgctctcaagaaaatgatagtctgttaagaagaatttactggaagatagataagtataatactgaaaagtgtgaagaatgaaacaataagatgtgcaaagtacagtgctgtcacaaaagagagagaaataaaagctaactggacaggtcagaagaggcttcacatggcactgtcttgaagaatgcatagaaatattctacaaccagcaacttccaattcagttgaactatctccatgcttcctgttcaaccgagattacattttcaatcttgtttctaaaggaaggaaaaaaagatgagtcatttggtacaaaaaagcaagaacagctatagtctacactataagataaatgtagggtactctttaaatctagtggacgctgtccgtaccctttcagcgctcccattttgtctcatcatctaattgcgtgcacctgaagactttctctgatgggtttgccactgcggggaaggctagaagtgctggaatattgaagacccaagcagcattcttcaggttaataatagatgagaattggatgataaaaactctaaactttttacactcaaataggatgcatgaggcatgtctatttcatttgctagaagtctccagtggcattaagtcccagtcatccatagtcataacttgctcattaatgtactctgtgtgttcctttcttctctatctcacttctctacttcctgttgatgctttctgtgatctccatcacagatcttcctgtttctcacttcctgttgatgctttctgtgatctccatcataatcagctacatggactcaaatttgtcatttaagtctgatcttggggaatccaattttagacattgagcaatggactggctgggagggatgaaagaggagacaaaggggctcctatgttcctggttcaggaaacggatgaataacatcaccagttagtgaataggcactgcctttcagtacctacgggagtgctttgttcagtacatatcctgcccagccaagcactgaagaattcatgaattttattgtaacctaaactgcctgtggcattatgaacctgtgtaatcatgggtagtgttggctttataccaggattttgctagcttgttagcatctccatgtgcatttgcaagaccttggccactcttcagtgttttctactccaatttgcatcattgtccctgcaggatgtttatcactcagacattctgaaatttggactgatgcttgacttagctctgtgattggatgcttctcccagaacctttctcacctctatcagctacgctaatgataatctagacagaggtttccctccacgggtgctgcagctcaaactgtgccctagaccactgtcagtcaacctcttcaatgccactgtttggtgctttgcttggttctttcagtctgcatgaagtcgcagctactcaacttacatccatgaagcagcaaggggaaacttcccattctcagtgttttaatctgttctctgttataaaggaggcatagtagagttgctggaccccaaagagtgacttgtaataaaataattctttaaaatgtatacatagatcttgtatcccagggcacacatttgacatgaaaatggctgttttggttgtaagtgcaggtaacagccatcaaggtgtacttgggactcctcctccactccaaatcttaggcctcattattatttagtttatcctgtctgtatctgcaagatgatttttacgtgagaacactagacttaccccttgacactgtgctttttgcagctcctcatatttgatgggcatgaaagctaatatgttgtctaattatggagagttttaagttattaattttatttttatcaggagatccttaaccccctatacaaattagatctaaatagatactaaaagatgaagttaatatttaactcctttacccaccagatgtagctgaatctttgcattggacaagtgagaatcctacttactctgaatcttagatactttgctttgagtatgattcaatgtcactgttgctacagaagtataaatgatggttatttatgcttgcatgttttccagaaagttaaagactattttattatattggctttctgattacttgactgaagttcataaactaacaaataaaaatctaaaaacactctctggggacctagacaaactataatgattaaagcatatagttactttgaagccaagatgaggtaaaggggataacttaagacatatttattcttaggctgacatatcttgtcattattatgttacaggtgcacatggaccatttattttttctcttatgaagaatttcaaacatatacaaaataaaaaagtaacataatgcataccatacactgctcattagctctaaccattattatcattaccatctggtttcctctctacctacccacttcctattctctgttttgaggcaaatccccgaaagtatatcacttctactctaaacatttcagactgtattcccaagtaacccccccaccccacttcttttttttttttttttgagacagagtctcgctctgtcacccaggctggagtgcagtggcacgatcttggctcactgcaacctccgcctcccaggttcaaatgattctcctgcctcagcctcccgagtagctgctactacaggcatgcgccaccacacccggataatttttttgtatttttagtacagatgggatttcaccatgttggtcaggctggtcttgaactcctgacctcaaatgatccgcccaccttggcccctcaaagtgctgagattacaggcgtgagccaccgcacccagccccggaaaatatttgcttaatatcatcaaatacattttatatttcccaaattatcctataggactcctctcttctctctgttgtctctgtttcctccacaccctacatcctcctcctccctcatcctcgttctcactctcccttttcatttttgaagaaacaggaccttttgtctaggtttgttgattacatccacatgatattgtttaatgtgtttcaccagctcctgtggtgctgacaaattagcagctaagtctagagagctacttgtagtcagtttgattttgttctttttttactcaagatgattgtatagaaagtgttgtgtactttcaacaaaaggtatataacgtttgatattggcagccattgatgatcattgttttgattgattatttcattatgagttgcaaaacaatgatatactgtttttacttcttcatttgttaggaggagcagttctataaagagaactttttgttttgttttgattttttgtttttgagacagagtcttgctctgtcacccaggctggagtgcagtggcataatctcggctcactgcaacctctgcctcccaggttcaagcaattctcctgcctcagcctccctagtagctgggattacaggcgcacgccaccacgcccggctaatttttgtatttttagtagagatgggattctgccatgttggccaggctggtctcaaactcctgacctcaggtgatccacccacctttgctttccaaagtgctgggattacaggtgtgagtcactgagcccggcttataaagagaactctgcatttctatttggttgcctcatagtataattgatacaaagcaaagcagagtaaatgcttcagtttttcccccaaaagaacaattttcaaaataatgaattgcttctctagtctcttccaaaagttgccagtgaattttttttttttttttttttgagatggagtcttgctctgtcaccaggctggagtgcagcagcgtgatcttggctcacttgcaacctccacctctcaggttcaagggattctcctgcctcatcctcccgaatagctgggactacagacgcgcaccaccacgcccagctaatttttgtatttttagtagagacggggtttcaccatgatgttggccaggacggtctcgatctcttgacctcgtgatctgcccacctcagcctcccaaagtgctgggattacaggcgtgagccaccgcacccgaccaccagtgaatattttatttatttattatcatccagttgtttgttttggcatcactgcgaatgcatgaatttaaatatatttaaatgtaactgaggctctccaccttctgtattatgatctttattgtcctcatatttttcatctttatgcgatggaagcctcctttacattgacctcctgagtcctttctgtatgacctttatacactttggttgaccccaacttctcttgtagatcaccagtgggcattcctgaggtgtgggtataacatttatctctggattatttattcattcagaaactttacttagtaattaacatttactaggcgttaacaaggaagcagtaaagcagcaaacatgctcatttcaatatttggattaatacaatcaatcaaaacagtagttattgacaacttacttattgtgtggttagcacactcaaaatttatgcagagaaaaaagatgagagattagacctcctccttactgtaacacattttcaatctgaccagagattttgcttctgcaaatttggatgcctagcattggcatcatcaagactttcatagctatggaaccatcagatataaaatacaccttagtatgcaacctcaacgtgttcttcctcttgcaattgaggttatattaatttattaagttcattttgggataaagaagacagaatcatagttctttcagcctgttattataacactttattatcctttacctccttccaatttttgtgtctaataattcgtgtgcatgtgaactgtcttcacttttgagttttattatgaaactcaaactacaatacacatgtatgcataaatttctgtatatgtggcatgcgtgtatatgtgtgtatgtatgtgaatatataaatttcgttgaatagagtggtatgattgtctttggcctccttaattatatatattagcatatgttctagggctcctgacgcttcttgcaggcagaaggcatttccagaggttgtgtagatccatgaaggacagttatcgggtcacatctcacatcatcactgtttctttcttgcccctgtcttacactagtacccttcagggtattgtatgaaagcttcattggttcaaattcattttgtcctctagtgctactttctatgctgacaaaagcatagtgaaactgatgccctggcttgtactgcagtaatattgcctccaagcatatcaagtacaggaagttaaatcctatatattattaagccagatcagtaacatgtacccaacaatgtggtgagacatattttgttttaataaaacgatgatgttacaaattcttcaaccttcccatatgtgtggaggtgtgtgtgaatgtctgtattaatctaccccatgtctcctggatagagtttttctacaaagaaccaagctcagcttcccctagtgttaagacattttgcttcatgcttggtatagtgtagtgctactcaaacctgagtaataaacaggccagtttaaagaaataaaaagccctatgctcaaccaatgctgattaaaattatttttattaaaatttacctatagaagcacgaatataaaacaaagggcacactctttatggtgaaagggcatatagatctacaacaacaaatcatattttcaaatcaaataaaacagaagtacagaaaagcaatagaactcaaaagcataaccttaatgtgtctgccaatgttgtcttggatacattaaatggccttttataatgtgaatatagtactagctgcaatggtgcaagttattgtatttttagcatttttcaatatatgttgtgaagactattttactgcttttctctattcagatctttgcaaaaaaactcatgtatacactataatcatgttttttgccattttgtagtcctatgcttttgtgtcatcagccttccccagctagaaaagtataatattctattattgtatgctgttgtcattttcccacaatcaaaagtacaaattattaaggaaactgaagtttcggtctaaaatgtgttgttcagatgaaattatccataagaaattaaagttgtgttcttataactggaaaaagaacttaacgcaagtataatatgtgcaaaactgggatgacttagttcttgctatcattaagaggggacaaatggcaacgagacgagctttaacagctgagaaaatcttatgcctagatgtacataggcctggaaattacatagcagtaaaactgtaccttcaaatagctcaaaagcagctcataataactgcttgagattatctcagtgataaagtcagtataacatagtgttttttattttaaaaaggaaaaatgattactttctttacagtatgctaattaaaatatacaggtgattgaaaaaactattaataaaaatcagtaattttgttgagtgggattatgaatattaattatttaattaaaatttccttcaatagttaacaaagatttattgagtttctgagtcaagcattcttctaaaggctctgccttattagaatttttaaatgtatttgcaatgagtgtatattaaatgtaaaatgtatgattcaggtttaaaaaaaaatagcagtgagagtaattgaatgctgaggttaaatagaatgggtgaatcaaccataccataaaaaacttctaagtggatattatattccaggcactctttcctacttcagctgttgataaaatcaaatatttccttagagacccttgactaatgcaggaaataaatgaatacttgcctatatagacaaaataataacaacaaaagccagaaaccaagccataccaaaacgaaacaaaaacagaaaaactgtgatgacataacttatctttcaataggattttctcagaatgggaggcaatatatattttatgcttccatggtctgtagattccaacatttgtataattaacatatacaattttacaagggaaaaatactattcaacaaatacgtaaatacgttcaatgtaatcatgcagtacttcgtttaaattgaccttttttttttttttttttttttacaaatggtgcaataaaataatcatgtttaccttcttcacatgttcattgatgttggcgtgcacggttttatctatatgatgtgaccttttgagaccacatgacattcacaaactgaaactaaaccaactaaataaccagttatccaaagataagcaaaagtggacgtcagtttaattagtaaggggagattttaatcagtaatacactattataatagagaagagttcagcatgaactgaactgaactttgatttgtgtagaggtgactgggagttttaaagggagaatgagagaatgagtttgagtggtggctcattaaagtcagggaagtaacaaattacaaaaagtggaaaggtgggattgttccctgggaaacctctacgtttgctaaatggcacttaaggttaggctcctgccttctcactgtcttcgggttttgactggaacaaagggtaaattattttggcagctttgagttttctcagaaatgcaccttaagtggggctagagttatcctagagaggtggctttgacctgttagaagctatgttagtgttttttgttcaggtctgtgcaggccaaggttatggcctagctgagaagagggctcagaggagcctagctaaagtttggtcaaggggagcgtcttggtggagcctcactcctgttcaagtaaagaagacacattattcatccttctgaacagtgtaagtccatttgtcattcgattgccttttgtttactaaggactagctaaatcatcggttgagacttgctagtagagcatagttgctggatgatgcacgtgatcaggcatttaatgagaggcacctctatggaaacaaacataaaaacaaaaacttgttggagaagaatataaatcctatttgttgagtctagagggcaggcagttaagaagttttctagacattgaattctaagcatcttcagatggtagagtggtaatctgatggattttctggtttatggtttgaatgtggtgatggcataaacattaatttcacagtcatagttatttcctggaacagaacacggatgatgctggagttccagtggactttctgaatggctcttgtagcaggagctccaggcatgaaggttgcctatacgtgatttgttgtggtggtaagtcttttgaagtttatatcaagttcttgggcttcagtgtgcaaggctttttcaaatcctgggggagaaagacagctacaagacaaccttgtaggttgtcccagtagaatcagtaggttgtaggagtcccagtaaggatttgggcagtcagattttaattctcagtgatgtcaagtcaagagggaaggcaaaaaattataaacatcaatttggagagatgtagcccgatattgaaggaaaactaaacaattgagtatttagtaagagtggcaaaatgggtgagatggcagaattcagtttagtttacaggtaaatgataaaatcctcaagacaatgaacaaaattggaatctgataacccacagtggtgtgttttacataaaacacaacaaaaccggaattggatgagaagagtccctggatctagggtcatcagaatgtagctattaagagttggattctgaagccaaattcaaattaggtgccttgtactttgcgcactgaatgctctcaggcaaattatttaccttctttgtgcctcagtctattcatttacaaaaggaatcttaagagtatatatctcataggattgttttgaaaattaatgagtacgttacattcaactgtgtctgccacattgctgtgaagttattaccttcctaatatacttacaaacttcataattaagaaaaaataaaaattcataaaatgaacatatttgtaataacttattataaatattgtatagttcattaaatgtattacctttagacatattaaaaataacacacccctcatccccccccaaaaaattcctgtatgcctgttttaaagcagttctgcatgttaaagctgcatttatgatatctaagaagtgttttttctcctaaatagcaggttggtaataatgtatattgcaatcgtaataatgtaagttctggttacaatagtttatctgggtaacatgtagaagttaagtgaatgaggtaataaattaaccaataagattacctttctggtagggaggaaaaacacttctgggttgaattaatattttgtacacatatgaaaggaagaagaaaaataagaaataccatttgcaaagctgactttaataaattttaattgaatggataaacattttagttaaaggtagtaatcttaacttgagattacttgagataaaaatatatattttcttaagagacatgattgttagataacttagagatataataagtggaagggttttccattaaggtaactgatagtccttaggtaaattaaataatgggaggaacttgtgttaggaaatcaacatccgagttacagttaaattggtgggagtctttccagtgcctgaagatacagagattttcaatagaaataaggtttttctgagaaattaagtgaaataaaatgtgcaatagtgattgataagcactgtttattgaagaaacgatttatctttattcttgccctttgctttttaaaacttttattgcattttcttctatttttaatacactttgttattgaagcataacataaccatataccataaacacagatagctaccactcagatcaccacttggatcaagaattaggaacgaacatatttgattttaactgcagtctcttctctcttacgctgaaaatctatgtttctaatgacattagtataattgcttatatggtaattaccttactatatacatataatggttccaaaataacagttcttgaattatttttataaaacaaaattaacacaaagatttatagtgatttctgcatttattttattattatatgtttacagacattggctaatgcttctgatgatcaggcttctctcgattaactgaagatagccttactctgcagctgtgtatttcttattccatctggagcctatgccatcagacattatgtctgccatattttttcttctgtggaaaatcagttttctttctgaagtgcttatttttacctttggctgctgatgtagatctttcatttgttcttcatcttaggctgtgccctggctctaaaaagtgttctcactgtctctttgctttcatttttttcctttcctatccctacgcccttaaatcacaatatctgtcagagttccagaagaaagaataaatactcaaaggagtcatgactattataatagttgatagtgtttactttggcctagttgtttctagatttgtctcaagaagcaaacaaaccaaggattatatatataccatcttgaccacaaaccaagcctcagattcctctatacatatgtcttaagttaccaatacatgttaactgttataatatttctttgactatatgtatacaccatgtagatgtagactatgtatactttgcatcctgctgtttatcacatgcctggcacatattaggcactgaaatagttgcttaatacatcaaaataaaattgaatagggaaaatataatttcttaagttagcattcccctctctccacccaaaagtattaaataaaaaaacaagagtttacgatgactttaacattatgatagagatacaagaaaaacaaataagtatagtaattgaaatggtgcccagaacaccctctttgttgacactaaaagtaagttcatcagaccaaatctgtactgttcagctctggggaacataatttaaatgagacactgaaaaactggagcctgtctagaaagcaacttataattttagggacgtattagctgttttcaaatattcagctaatcagtggaaatgcaatgaagcatattcttattatgatgagaagaaaggaaagagagccctttgtccactaaatatttaaacaaacaaactttgtaacagtgagagatggccaaaaatataaaaagcttaatctggaagtagtgagttgtttttcactggggtgtgggcaggggcttcatgtctatttaaggaatgctgtgttcccatggaaaaccagcacaagacaaggatgccctctcttaccattcctatttaacatagtattagaagtcctgaccagggaaatcaggcaagagaaagaaataaagcgcctccaactaggaagagaggaagtcaaactatctctgtttgcagacaacatgatgctatatctagaaaaccccatggtctcagcccaaaagcttcttgtgctgataaacaacttcagcaaagtctcaggatacaaaaccaatgtgccaaaatcactagcattcctatacaccaacaacagagagaaatctgttccattgcatctgttgcatgcagtgcaacagggagaaatcagtaatgcaatcacattcacaactgccatagaaagaataaaatacctaggaatacagctaactagaggggtgaaagatctctacgtggagaactaccaaacactcctcaaagaaatcagagatgacagaaacaaatggaaaaacattccatgttcatggataggaagaatcaatatcattaaaatggccacactgctcaacgcaatttattagattcaatgctattcctattaaactaccattgagattcttcagagaactagaagaaactattttaaagttcatatggaaccaataaaagagcccaagtagccaaggcaatcctaagcaatttattagagtcaatgctattcctattaaactaccattgagattcttcagagaactagaagaaactatttcaaagttcacatggaaccaaaaaaaagagcccaagtagccaaggcaatactaagcaaaaagagaaaagctggatgcatcacattacctgacttcaaactatactacagggctacagtggccaaaacagcatgatactggtacaagaacagacacatggatcaatggaacaaaacagagaaccaagaaataagactgcacacctagcaaccatctgatcttcaacaaagctgacaaaaacaagcaatggggaaaggactacctattcaataagtggtgctgggataactggctagccacatgcagaagatagaaactggaccccttccttacaccatgtacaaagattaactcaagatagattaaagacttaaatataaaacctcaaactataaaaaccctggaagacaacccgggcaataccatttaggacataggaacagacaaaggtttcatgacaaagatgccaaaagcaattgcaacaaaagcaaaaattgaaaaatggcatctaattaaactaaatagtttctgcacagcaaaggaaactatcaacagagtgagcagacaaactacagaatggaagaaaatgtttgcaaactatgcatccgacaaaggtctaaaatccagcatttataaggaacttaaacaaatctatgagaaaaaaaaaccctactaaaaaagtgggcaaagggcatgaacagacacttctcaaaagaagacatacatgcggccaacaagcatatgaaaaaagctcaacatcactaatcattagagaaatgcaaatcaaaaccacaatgaaataccatctcacaccagtcaggacggctattaataaaaagtcaaaaaatagtagatgctagcacggttgtggggaaaaaggagcacgtatacattgttggtgggactgtacattagttcaaccattgtggaagacagtgtggcaattcctcaaagacctacagacagaaataccatcaacccagcaatatcattactgcatttatacccaaaggaatataaatcgttctattacaaaggcacatgcacacgtatgttcattgcagcactattcacaatagcaaagacgtggaatcaacctaaatgcccaccaatgatagactggataaagcaaatgtggtacatatacaccatggtatactgcgtagccataagaaagaatgagaccatgtactttgcaggaacatggatggagttggaggccattatccttagcaaactaatacagtaacagaaaatcaaatactgtgtcttctcacttgcaggtgggagctaaatgatgaaaacacatggacacttagaggggaataacatacattgggacctgttggagggtggagggtgggaggagggagaggattaaaaaaaaataactgatggttagtaggcttatatctggatgacaaaataatctgtacaacaaatccccatgacataagtttacctatataacacacatgcacatgtacccctgaacttaaaagttaaaaacaaagaaaagctgtggataggtttggtggacaaactaggaactggagaatatatgggaattttacaatagtctcactggagccttagtgggttttagtagtgtttcaagggccatgtgtagggtgagaagacagtggatgcccaccaccaccactaccaccatcagcattcctttagctgaatagctcactcttcatctgtttcatattgggcttctgggtcacattctatttaaagaaagagtttccactcgactctgaggtccttgaatccaaagtatctctcataggtccttggagcaatcgtattggaatttttaaaatgttgattgaatggcttgaggtgaaaggaacctgttgcacagaactagttctctgttatgagtccacaaaggtcttaaattcgataaacattgtttttactagtaagtgtcttagtatcttaaaattatagtaagcttgattcttttctatcatgttggcacagttcagttagcaaataataaaatgaaacaatgatgatatgtaggtagacatattaacatgcctttgtatggagcaaacaataagaagcagatgggacagtctgaggaacgcattaacaagagtttctgaagccaactgctgctgcacctgttaacctggaaggagattaatgcagtagaacagctactgtctttccatatttcttaccacaaaaagatgttttattacattcattgtaacctcttggtaacacattcagaatacaagcttcttcctagtttccgcacatgtctttctcatgatagcatactgtctttgaaaattccatctgctttgatgatttgggctattctatcaaggcaatataaaattgtttttcttaaactttattacaggtcattgagtttcatgatctatagtgaatatttctgtattgatttgttggtatttttattttctcttctcaagctccttgtaagtggggactagcaatgtattttttaattttccgaactatttaaaatctttgatgccaatgattcaacttaaattctggttatatacaccaatgataatattttgtatctagccgatatttaatatttatcatttttttaaagaatcattcactttcatcactatcatagagatgggacaaaaaatataaagactattttacgtatgtatgacttgcttggtaattatttgctgaatgaatgaaaaatacaaaaattgatagttttgctcttacccatcttgtatatctcttccagtgctcattttgcattatgtattagttcatctttgcctttattaagagtagaaaacgccatttcatcttttacatataaaaatgagtctggtctgatacagttactcacatcttcgcttaaatttcttttcttcttcttttttttttttttttttggtggagtcttgctctgtcacccaggctggagtgcagtgacgcgatctctgctcactacaacctccatctcctgggttcaagtgattctcctgcctcagcctcccgagtagctgggattacaggcatgcaccaagccacccaactattttttgtatttttagtagagacggggcttcaccatgttggccaggctggtcttgaactcctgacctcaagtgatctgcccgtcttggccttccaaaatgctgtgattacaggtgtgagccaccgcacccagcccagtgaaatttcaatttgaatttggaagctctactaaggtagtaatgtgaactttcaatattattagaaagctcatcaatctgaaatttaacataaggtaaagaaataaaaagcattaagaccttacttcatatgagagctagaatccatgacctgaaaaataaagtagataaattcacttataaaactataatttaaactcttaacttgtaaatttggggaaattagtggtgaatgggtttctaatatatggaacatgaagcagtaggaaatatgttatgagttgtgacagatattccacctcccacgagactgtgatttttagaatcgacgtgttataaaattgatctgaactttgtccctgatgctggaaaagtggcaacctgtgactgctctaaagtaagctaaaggagctgaacaaggctgggcacagtggctcaggcctgtaatcccagcactttgggaagcagaggcgggcggatcatgaggtcaggagttcaagaccagcctgaccaacgcggtgaaatcccatctgtactaaaaatacaaaaattagccgggtgcagtggtacatgcttgtaatcccagctactcggggagctgaggcgggagaatcgcttgaacccaggaggcagaggttgcagtgaaccgcgattgtgccactgcactccagcctgggcgacagagtgagactgagtctcaaaaaaaaaaaacaaacaaaaaaagaagctgaacaaatgctggcattcatacatggtttgagaaatagccctttttcatttaagggaaagacttactgagatccagattgagaaaacaccccatcaacaataaagtggctcaggaaaatgttttatactagcacatcttcaagtttctacttaaggctattctacatgaatatttaaaaagaggagatgtcaaatataaaagcacaagaggccccgagggcttagtatctttatttgcgttaaggtttctcataaataattctatttggggatataggctctggtatatatgtaataaatgtgagtctttttaatatcagagttacccttaggatagtaagtgtatttatttcaaagaaatataaaaataaaatgaataaaatatttcaggtacctcagatcattgcaaattagtcctcaagtctctttcagtttttcttggattatatgaataatgctttgggatagaggaaactcaccaaagtatatttctgaggactgggggtgggaaaggtttcagaaaggagaaacccatgggaagaatttttctactgactgtcaagtaattcatctcaacagaagaaaagctgattttcgatcagtttaaggtaatagaatatgtcagaattcctggggttttctttgttcaatagcccacttaacctgctgcagaacaccctaggaataacaaatgaatcataaggtagagggacattccagcacacttgttttcttcaaatattgatattttccccttaaaattatatgtctagaaaagcttttgctcggacagagtctgtagggccagaaatataaataactgtcaaatataaagctgaatcgcctccacaagattttaggaacttctgggctggggaaatgtggcctgaaggaaggctgctggtttggccactctctgtattccatcagaaaaaatggtggggtataatcagaagttgaaatgctcacagtagttttaccccatggcttgtcagctgaatattgcgacaatataggaattcttcatcgcagaaggaatgagcctccctggactgatgattttctcagtttatggtgtgtgtgacgtttttgtaaagtggcaaatagttgggggcatgagctagaaggtaactttaggaggttcaaccaaccaagtaccacctgcgaattggacaaaattcaatggacaaaagaaaacttaattgtcagcttactcccgccttttactcccgggacctagcttatagcacatggttcataaaagactctataaatgattactgaatgaatgaataagtgaaagtgcacaaatgaatgtatctctgagattttaagacacttttgtgttcatgcgtcttgcctacctgtctccggtccttctgaattcataaaaagaagaaagttcattttttctggaatgactgatcttaggaaataggaataagtaattctgatgggtagaaagtgcagtgtatgaagattcagaagggtaaggccaattaatttaaacactctgagtctatgttctaacctgtaaagaaggctgataatatttgccttctctgctatggtgttcccgaattgtgctttccaagaaatataccatcacacaatatatggccgtggtgaatacagtctccaatgtccttctccccctgcaatgtgccaacagagtgatctccctaagcatacagggtggtgcagtgtaaaggcacactggtttctgtttgaattccagctttgctacttactacctccataatgtgtagcaagatacttcatcactcacctgtaaaatgatgataaaatgatacttatttctatgagaattaaatagctgatacaagtaaagagcttaaaacagtatttggcctgttttaagtgctcaatagatcctagatgttgtcattgctgttactactgctgctgctgctactactactactactacatatttgtttttggaccctacttaatcccataggttgccacaactactgtctacataatgaaatctaacccccaagtataggatactggtttctaaaaatctagttcatggctatagttctagcttcattcaccaccgttctactagcaataccagtccatctgtatttcctccaatagaccactctatttttttttttttttttgcctctgcacctttacactggatgtttattttgcctttagtcacatatccacaaagagatgttctgggctccatatgatggagttgcatacagtgctgagcttttctttcagggacatattcagaaaggatgagtttttgattgttgtcaaatttgctgttatgctgattttttttagaactgtttgggcgactaatacaaattcatccaaagcttgttaagaatacattgtaatcatcagtatttttaaaaagcgattcttcattctttaccattgtgtttcccatcccaaggatttcttcagattaaaatattaaatgggacaggcaacactttgaatgtaaaggagaaatgggaaacactaacacaatggtggcatgataggggatgaaacacagaaagttggaaccaaaggggagcaccatcgttcatatttatgtgtaaggaaaagaacagaatgtccttgggtagtttactatttcttaataattctcctcacttttaggcaagcttgccagtttttttcagtggggatcacaaatgcctatctgtctgtctgtctgtctgtctgtctatctatctatctatctatctatctatctatctatctatctatctatctacctacctacctacctatctaatctatctatcatctaatatattatgtgtgcgtgtgtgtgtgtgtgtgtgtgtgtgtgtgtgtgtgtgtgtatgtaacgatttaattgaagcaatggtaagacattacaacttcaaaaatactgttttacttcacatacactttacctctaggtttcatagcaagacaatagatgggtgtagttttagtattatttacttttatttgttaattcaaggcactatagaaatacttaatctgtttaaaccccaaacatctctttaaaatattttatgtgacgagcaaacagaacatcatgatctaataaaaatgaaaatgtttttgatgttaaatgttgaggtaaaacttttgttcagttattataaaataatgacattttgagaacctcttatttttaattttatcgtctctaaaattgagacaatcacatcttggtatcgataatttttgatgcatgatgtaatatttaaaggactttaaaaatgtaaaatgctgcataaatattattgctctgcttaacagtgtttcaaatacatttttggaaaaatagcaaagtaagagataacatgtatctaaagttctcatcccttatcaactaaatattatgaaaaccttagcttctcttgcttctccagaatgacagattagcttcagcctaccttagactaggcatatggaattggcaaacgctctccttagcaactgcaaagttcaccgcagatgcatttaacagaaatagcacagatacaattaagcaggtagaaagaaagaatgagcatgtaaaacacctacaatattccagatttcctgctcacttaattggatgattcagatacctctctttcataatgtccaggtgaaagaaatgccggttcctcttatttctctacatcaaactaaagctccacttaccagagcaaacacaagtacaatctgttatgttttggactgtctaatccattctctgtagtttcacaagaatctggtgagcttacatggcatccagagaacagggtgatgagtaaagcccttaactctacattgtctaaagaacctgatttattcaaagaggaggcagctctctcacttcttattaacagagggtagagagtttctttcccaaggccaagaggggttttagctattaatacactttctctccctccgtccctggtgtgtgtgtgtgtgtgtgtgtgtgtgtgtgtgtgtctgtttctctcactgtcaattttgagtggggtttcaaggtttaaataaggtgacaagtctagtagaaaaatctctgaaagagctatttgtagaacattaactgactagttgtgtgactttgtacaaccagcttaaggattcagttttataacagataagtttagggaaataaattgcactgcacattgccttcggtctgttgtacctcaaatagcttaggaatctgttttctcctaaaacatcttcctggaagctgggtttccgctccaccccacctcccatgtgtttatgcattcctctgctcctccccttaactgagaatcctcattagaggcctgggtaaaatgtttcattgttagagttataatatatcaataatttacattaccttaattttgtaatttcccagggcattttgaaatgttatgataacatgaaaaatgtatgactttcctcaatgaaaagttaattaacaattgcttttattcttcaatgaacagctttatggctaaattattactagttttgtttttaattagatgactaaataatgcaaaattagaccatctttgtcctgacactgaattagaccattctttggcaactcgtgtacaaactattttcatttttaaaaaaatgtatgattctgagaacaagtaaatgcaattagaattgtctttcagagggaaagtggccccaaatgatgtcaagaagccagttttatgataaagatgtctatttttatgaaataaaagtaaggagaaaaaaagaattaatacaacttcactttgagattttatttttttaattcttgagttaggctgaaggccagatttgtaattgctcgtgtatgtgctttctaaaacttgcttaaggaaaactggatggattttctaaaaggcaattaaagatttgcagttgaaaaatcatcctccctcataagtattggtgtatacagtggtttccctgcatggaggatatgctggacaatatattgagaactgcagctccaggcaaaattaaactagtgttttttagagatactaggattagcttgtttactaatttgttaaagcagctgcgtttacgaaatacataagccttaagttttaatcttagaaacaccctttcccaaatattctaacaagctcaatggtcctctgcctttgctgatatttagaacatcacgagagtctttaaaacttacagatgcctaggtcccacctgggaagtttctaatttaattggtttaggtggcaacctagtcactgggctgtttaaaagctccccaggtgactataatgcacaggaaaggttgcaagccattgaacttgtaaacaatatagcagctcccatacaaaagcccgtaaattcaaagaaaatccagccatatgaacaagaaaaaaaatgtcaacgaagcagggacttcataaacatatgtttgcaacaacacatcattgaatatgattaatttgatatatctgttttgttataaaatgtctagaaaaaaatgtaatgtaacaaaaccagcaagcaatttaaaacaaataggaaaagatgattagtagatcatatgatataatttttagataatacaggaatcggacattgaatttacgttagatttttatagacagatatacagaaaaacactcagagtagacaacaggatgttagcagtggtgctgcttaatgaaaaaatgagttatctgtacttttcttaatagttattgttgtatctttttatggtaaacatacattgtttttgtaacaggagagaaaaagtagtgttctttccttgaaccaaaaaaaaagtaggccatttaaaaattaatgaataaggaaaatacacatgaaaacttctggaataagaacaaagctgtaatcaaagaaaattaatagccttaatttttttatatttgagattaaagggaaaataagagaactaaacatttgattctgtaagaaacctttaaaaagcagtacaagaaataacttcaaaaatactatattgagaaatgctttcaaacaactaagtatgaattatctgtttacaaaattccaaaccatgaaaatagtatttaaacctctatgttcatgttctaaagcccttataatcttgattatgagacttcaaaaaaatagcatacacattgaaaactatcaaccaatctcaggaatacagacgttcaaatcttataaaacatagcagatttagccaataagagaagaagttatcatgccaaattggatttatttcaggaaaacatatatgcctactataagagaatctatttacatccttcattgtaggtaaagatcagaaggaaaaaatatacaatactttttagttatgaaaaagtattgataaatgaaaagaatctgtccctaatttaggagtagaaacaaaacttttagcaatgtaagaatagatgatagtttataagcatgaaaaatattgtctatctcaaaacaagagccaactctgtgatcaatgttgaaatattgaaggtatcctcattaaaattagaaatataactagaatgactaccaaaactgctctttttaaatgctattttgcatattctagtcagtgaaagaagccaagtaaaagaaacaggaagtataagtattggggaaaaaagtcaaattattcatattaatagatgatattgtcaacttggtactaagtaaatcaacaatgacaactattataactaatgggaaaaattagtcccaaagctcattaagaaaagaaaaaacctagaaataattaaatattaattaaatgtaatttttctaaatgctaatttctcttttaacaacctattgaaaatcaaagctatcattttccacagaagttcaaaatgtgaaattactgtgaatttatttagcatgaaatttggtgatatacaagcctttactggaaaaataacagaatatttgcatccatggacagatataattttatatttcttggtgggaatattaatattttagacatataatttactacaaattaagctaaaatctgatagaaacacataaaatttaaattggggtggcaggaagacattggatgtgacaagaattactctaaagtttatctggcagcaatatagatgaggattaatagaaaatgttgaaaaccttaaatgaaaggtcatttgcccatgtagctattagagtgtttaataaaacttctactggctgggtgcggtgtctcacgcctgtaatcccagcactttgcgaggccgaggcgggtggatcacctgaggtcaggagttcgagaccagcctaaccaacatcgtgaaacccagcctctacttaaaaatacaaaaattagccgggcatgatggcaggcgcctgtaatcccagctactcgggaggctgcggcaggagaatcgcttgatccagggaggcagaggttgcagtgagctgagatttcgccactgcactccagcctgggcaacagagcaagactctgtataaaaaaaaaaaaaaaatctactaaaagtctatacaaacagattagtgaaacaaaagagaaaatcccaaaatatgctcaagtgtatataataaaaatggaatttcaaatcagtggatagagatggactatgaaagaaatggttttgataatcatgttaaaaggcaaaaccctgctttacacaatgcagtgaattaaatttcaccttgaacaaatattcaatcataattaagcttaagaagcccaaagaacaggaagaacgataggtgaatatttctacaatgaggcgatggtagagaactatgtagaaatgattttaaaaacccaaaatttaaaatggaaaacacatagataatttttaaaatctgtacattaaaaaccagtaaactgaaattgaatcttacaaatcaattcagaaaaataaatgcattgcctaattttaagcatacaggaagaaagtgttagacctggaggtcattattttaagtgaaatgaaccagacacagaaagtcaaatattgcatgttcacccataattgtgtgctaaaaaatgtgtacacatgtacacagagagtggaatgatagacaatggaaacttagtagggtgagggggttggagtggagtggataatgagaaattaatgtgtatgatatatttgggtgagggacgctctaaaagccctaacttgaccactacacaatctatgcatgtaacaaaattacacatgtaccccatatatttggacaaaaagaaaataaaacacatccaaaggtatatgaaaaaatgttcgatctcatttgtaaccaaataatgaaaataaaaataacttttccttgtatactttgtatgcttctgacagaagactgaatcaatttatttcatgagagcagtttgcaataccaatcaagagaaagcgtgcttacacttgactaagcaattgcatttccagggaaattatcgaagaaatgcttacatctatgtgcaaagactgagttgtacctatatttattgtttaattgttattacagtgaaaaatggaaacaacaccagtattcatcagtaggaggctactaaaaaatgatatatctctaaagaagggaaatttaaaataaaattttacaggtgattgcattgatattaaaggtaatccaaatacatacatgaaaaaataaagcagactgtaatacacagtatgtatacatataatgctgtattatgatcccgcttatatatgcatatatattaaaatataaatttttaacctctgggaaatgcattcctacctaattttaagtctctcattttttcttattggaattttaaaaagtgtacaatgcttattaatgaatataaatttgtttgaatcaatgttttcaatttttaatcaaattatctgtacatgattcaagtaatttttacttcataagttcttttatttaaatatgctgcattcctctctcatttctcactcctcagaggcagatatttgagtcattctctttttctaatgcgtgacaaatctgtaataacatgtttatatctctaattcttgattttctcattttttcatggtctacagtctctcttatgagagatgaaaaattatctcatttatatctaccccatgtatttgttctattaactaatttttcttttacatgaagaccttaaatgttaatttttttcttcaaaacagtgtcaaaagtatgtcttaacccttcacatgataaaatggggattttagtggtcctccatgtttcttcacttctcctactgaatttcttctcccaaattctgtaaagtctacttttaattttatgttgagttgcattccttctgtgttctctaactatgattaggtctcgtgttttgtcaaagatttattctaaaaattgaaaacatataaacagtatgtacactattattatagcaccataaatatatttcattgcagagtctattaccgtgttgggcttatatttcctttcctatgatttccatggcaatttacctctgctactttacagaaaatttcaagattcaagttaaaatggattctctttttttttctttttttgttttttgagacagagtctcactctgtcacccaggctggagtgcagtggtgccatctcggctcactgcagcctctgcctcctggattgaagcgattcttctgcctcagcctcccaactagctgggattataggcacacaccgccacacctggctaatttttgtatttttagtagagatggggtttcaccatgttggccaggctggtctcaaactcctgacctcaggtgatccacccgcctcggcctcccaaattgctgggattacaggcatgagccactgctccagccaaaatggattatcttttcttacactcagtaatctctcaaattcaaataacgacataggaaattcctaagtctattgagtctttatctaccaaatctccctctctttcactttctctgtctctcttatgtacacgtagacacgcacacactcccttctcaaaaggtaagagaataggatggtttgtaaaggggaaacgtctctggaaacacccacactttaataatgtcttaactaatcacattgcttgggtgtttttgttattttgtagtttgcggttttgtttgttttattttctgataacctgcagagtaggaaagaagagagtccagaaacttgttgtaaagctggacttcaagttggaagaaatattggaaggaccttttaaaaagagagttgtatgatatcgaagcagcctatttccctgaccccttcccgggactcgtgacagggttgcctcatttacctagaccagttttcaactccttatgggagggagcatgcaagtgaattccaggggtttggggtacgaatgatcctgtcacccaggtactgagtatagtacccaatagtcagtttttcaacccttatccccctccctccttccccttctagtaatccctagtgtctatcgttttcacctttatgtccatgagtacccaatatatagctcccacttacaagtgagaacatgtggtatttggcgttccgttgctgcatgaattcgcctaggataatggcctccatcacagctgcatctgtgttgctacgaaggacatgatttcattctgttttatggctgcatagtattccatggggtatatttagattttctttatccagtccaccaatgatgtgtatctaggttaattccatgtctttgctattgtgaatagtgctgtgatgaacacgtgaatgcatgtgtctttatgttaaaacaattttatttattttggatatatattcagtaatgggattgctggattgaatggtagttctgtcttaaattctttgggaaatctccaaactgccttccacagtggctgaactaatttacattcccaccaacagtgtataagcattcccttttctctgcggcttcaccagcatttgttgttttttgagtttttaataatggcctttctgactggtgtgcgatggtatctcattgtggttttgatttgcatttctctgacaattaatgttattcagcattttttcatatgcttgtaggctacttgtatgtcttcttttgagaggtgtctgttcatgccctttgcctgttttttgatggcgttgtattttgcttgttcagttttttaagttccttgtaaattctagatattgaacctttgtgtgatatgtagtttgtaatgattttctcctgttccgtaggttgtctgttactctgttgatagtttcttttgctgtgcagaagctttttagtttaattaggtctcgcttgtcaattttttggttttgctccaattgcttttgaggatttagtcataaatgctttcctaaccccaatgtccagaatgatgtttcttaggttttcttctacaattcttctagtttgaggtcttacatttaaatctttaatcatcttgggttaatttttatacatgtcgaaaattagggatccagtttcattcttccacatatggctagccagtccatttattgaacagggagtcctttcccattgcttatttttgtcaactttgttgaaaatcatatggctgcaggtgtgtggctttatttctgggttctctactttgttccattggtttatgtgtctgtttttgtgccagtaccatgctgtttttgtttttgtttttgctcttatttaaatgttataaaaattgcctatatttaagatgtataatgggatgttttgatgtgcatatacgcagtgaactgattactacagttaagctaattaacatatccatctcttcacatagttattttgtgtctgtggtaagaaaacttacaatttactctcagcaaatttcaagtatacaatacagtattactgactatagtccctatgctgtgcattagatctccagaacttattcattgtatgtaactgaaacgttataccatgctgattcggttgctgtagccttatagtatagtttgaagttgggtaatgtgctgcctctggctttgttctttttccttaggattacttttgggctcctttttggttctatatgaattttagtatagcttttttccagttctgtgaaaaatgatgttagtggtttgataggaataacatttaattcgtagattgctttgggtagtatggccattttaatgatattgattcttctaatccatgagtatggaaagtttttctatttgtttgtgtcatctgtgatttattttagtagtgttctgtaagtcttctcatagagatcattcacctcttttattttttatggctattataaatgggattgcatacttgatttggtgcttagcttgaaaattactggtatgtagaaatgttactgatttttgtatattgattttgtttcctgaaactttactgaagtcagtgctatttttagatggatatatgagaatatttaacttatatggagagtcatagaaattacacaatttgtatttcatacatcatccacacacatgctttctttacttaccagaatagtggaaatgctgcataaaatgaacttaatggtttttatttcctttcttcataaatgtacagtttatcaagaagatgccctttggcttactgacgtgtaaggagggactaaaaggaaaggaaaaagaataggtagctctaacttttcctttctgtctacatcatcattttttattgcaaggtggttggccaatataaggaaggaacaccactaagaaaagatattatgtggttttttggtcattagtgtttcttagaatgtcactcacttcttcctgcatatatatatctcaaatatatatatacacgtatatacacatatatatacatatatatctcaaatatatatacatatatatctcaaatatatatatatacacatatatatttagaagattatttggtgaatacactattagaacaaaaagaaagaagtattagcgaagtgacagggtatttcccaactcagatatatgatacctgctaatggactgttcgtgattataaatgtagtatatgctcattgtagacattatgaaaaacgtaaaatcccctataattagacctctatttgtgctaggcacatgatgacttttcttgctctgcaacaactattttttttctcttaaagtttataatgttgtcagtattgtcggatatcctcagggattccatcatcttttcttaattgtggttaattacttaaccaattattacaaattattttcctataatttattgctcttagtatcaaacaattaaacaccctaggaaatgtcttattacttgatctatgaactggtgagaatctatattctacataggggcttgttttctggttttaaatctaatacagtcgtttggcaaataaagacaaaaaataaatgttgtctacctacttttcaattatccaagtagtttaaaataaaaacatccttactgattttttaaactcttatataattgcctaattctacagtaactggggttggtagtaactaaaacctgttgtattcctagtgatgcccaatgagccttgggaaatgaataggtgggtatagtccagttgctagaaaatacttgcttgttactgacttatctgagaggaaataaacactttcatttatcagggacagagtataaagtgttcctcactgaagcatttctaaaagctctacagtcctttgaatactgataaggactctgaaatgcaagggaaaatatgcaagtaatctggactatcacaggttattttatgaactgctcatatttttactcctttgataagtattatttcccccaaccccaaacccgataaattcgataacccttttcatatataatattatcagcaaggcatcttagagtttcctttaaaaaatgtaaattaccaagagaaccagaatgattttggggctcataatggtagatcttaaagagagtggaaagatcagtagttttcgcattttgctacacattggtggagtgtttacaaacagtgatatctgcgttctatttccacagagtctgacttaagtggtctgtaatccgagcatctcagtttgaaaagtttcctagataattttaatgtgtatccaacgttgaaagccagagtaaaatgaaggaagttctggggcctcagataagcaacttcactacttttttcaggttctttgaataattgacatcatccccaaattcaaatcgttgatagtcatgatgagtacctgttttactccagaaatctatataatattggttacctcagtgcttgctcttaacttccataatcaaaggaggaagagagactcatcgtgttcagatacaggttgtgtaacgtgtgtctgtaaaatactaatgtgattgacttcatccatccattcacctatccatccatgcatccatccatgtatacctcgtgtacctccattcgtctactcatccaatgtctctgtctaggctccaggactgctgccttaaggttgtttaccaactcagtaggtagtatgttatcctcaggctttggaaacaggggggtttagttaaagagcaaaccaactcaacatactagattaacttgaaagggaaaagttatgcttagtgcataaattctttccctcttgtcctttcaaatccatttttcattctttaccactgtgctttgtgtcctggggactgccctttaggaatggcatcagagttcctttgccctacagtttccagttgagacaggctgcagcaggaggagtacagtggataagaaaagggtggagtatttattttcatgtggccccatgggatttccacaggttagctctgaacagctaacattagaccagagcttctgctggacagttctctcttgcatttctattgggtctggctctctagttcaggaaacgtccttcctcttaacccttgaggtctacagttaactctccgtcatcccttcttgaatttcctaacactgagcatatctctgttgataacccctttagcaaactggcctcacataccccgagattgagaaatcaatcctccagtttctaccgggactctgattgagttaatgtgggataatttgcttacactaccctcttataaagtgactatgtacattagcatattaactcctttgaggattttcatttacttttgttattaaagcattacacgttttttgataatgtgtaggagactcaatcatagccagaagtgtctcagacgcaagcacctgtaatgattcccttatatacagttttatcccaccagaaattgggactaggcacaagtgttctaggtaacatttcaggatcctactgtcataaagattattatggcacaaaaactatttggctagaagtatccccagactcctctgtgccacattatcttcctttatccagttatctgaggatgtgcttgcagtggcagactagcttttggggaaattttatttcaagaaaaaaagcagggaggaagaaaagggtaagaaatgaggaagggaagaggcccatgggctaggagtgggctgtcctgtttctgggaaactttgtgaaggtttcaggagtagtagtaactcatggtgaatgaaaatgagagggaattgttggcttttaaagtaataggatatgcccctttatgatgggattaagagatacaagtaagctgggcgcggtggctcacgcctgtaaatcccaacactttgggaggccgaggcaggcagatcacctgaggtcaggagttcgagaccagcctgaccaaagtggaaaaagcccatctctactaaaaatacaaaattagccaggcgtggtggtgcatgcctgtaaccccagctactccggagtctgaggcaggagaatctcttgaacccaggaggcggaggttgtggtgagctgagatggcgccattgcactccagcctgggcaacaagagcaaaactccgtctccagaaaaaaaaaaaagagatacaagtaaagttatgaaatcacctgtggtttctagacagttttttttgtgtgtgtgaaatattaagaacagaatacatgtgctaaaacattttaaaagcttaataaggtcttttaaatcttgcctcttccttttgctcgtctaatattacctcctatgtccacccccacggattatttacatttaatgctttctagtgaaatcattaaaatgagatttatggattattcataataggcaggatgaaaaaggaaggtgaggcgacagtgatccttccttagctgttaatggataaggagtttcacagcaagaggaaaaaggcataacattagtattaccggttgtctaagggggagagatagaattgtttttttttccttgcattttctgtactctactcttatttccaaatattctttaatgtttgtgtgactttgtgacttctatattcagcgcaaaaaggattaaagaattaatttaggaaatcaatttacactgagtgtctccagtgccagagagggagggaaggacattcgtagctacagtgttcataatagcaaataattgtattatggtcataccatggaatattatatagcagtataaataattaactatgatcacatgtaagaatatgagaaaatcataaaaacataatgtagaggtccacaaacattttcttaaagggccagatagtacatatttcaggcttctaggtcatattgcaaatacctaactatgttgttgtggcatcaaagcagccatagttattatatgagtgaataggtgtgagtgagtctaataaaacttcatttttaaaaactgtcagggaggccgggcgcggtggctcacgcctgtaatcccagcactttgggaggccgagatgggcggatcatgaggtcagcagatcgagaccatcctggctaacacggtgaaaccccgtctctactaaaaatacaagaaattagcggggcgtggtggcgggcgcctgtagtcccagctactcgggaggctgaggcaggagaatggcgtgaacccgggaggcggagcttgcagtgagccgagatcgcgccactgcgctccagcctggggaagtgcactcactccagagccggggagcccatgggcggtagtgtgctgacccttgtattagacaacactccagaaagctcaagcataggaacacctaatgaaaatattgttttggcatacatgcatgtgtgataaatcgaaaaaaccaacacaaaacaaatgagcaaacaaaagaaatcaaaggcaatgatatgacaatccccagattctggatggtagttaatcctgggtaaatggagggaggggtacaaaagagtgaagaactagtgtaggagcacataggttcaggtgtgagttgttgctaatatttcagttattgggatggacatatgtttgttttattattgagctttgtaatttacatatccattacatatattcttttatgcatcaaatatcacattacacaaagggaaatcataaaaattggggaaaaattggaggcaagcatagatcttggggcccagtgtagcatgcttttttctatttttaaatttaaaattgtttttagagatgcggtatttctctgtcacccaggcttgaacccctaggttcaagcaatcctcctgaatagctgggattacaggtgggtgccacttcacctggctaactaaaacaaaattcttttaaagatatggtctctctttgttgcccaggctgatctctaactcctggcctcaggtaaccctcccacctcagcctcccagggggattataggcacaagtcagtgtgcctcacttccttcaacattcttaaatacatcttggaagcacagtgtttattaccttgtttctaaaagagatgcatctattgtaatcatatttataatgttcttatatatggttttcattagttttactgaaactctcaacctattgttttttgatgatgactaccaatattcattgattcactgataatctttgtaatgtccttaactcttagggattagatgacattaaatctttatcaagaagtggattttgttacttaagtattttagtagcaacaaaattggtcacaacgacattccactgaagcagaatagtcagaaagcaatccaagccgcagaaataaattaggttgagcaagactacacctaatggcattgagataaagaccctactcctgactcactgccccgtgttctagtggtgtgcctgctctgcaattctccttaagttgatgtgcatctatctctttaggaccagggggtatttagtctgtaatggcttttccggcaacgtgtctcatttcagctgcttcagttgtcgagataacactctcgtcactgcctctctgatggtttcccattcaacagcagtcatttcatcttgggacacttttcctcacagtcaacagtttttcctttgtgtaattaagtctcatttttttctggatagatccatttgtgccagaactcttctgctgccttgaagcctgcaccattcagttatttttagtgttatctctttcctttcattagcacagagctaaattgtgcatattttgttctttcagctttatacagattaagatcttctagctccttagtcattcattttagctgttgcattgaatttcctacagttcatttaaatcacccagttcagtttaatatgcccagaataaataaagcatcattttttttcacatctaatcacctaccccgaccaatggcaagtgtaaggattataaacctttgtgactttgcctgtttactcccttagtaggtgagctctgagccaaaatataaattcattaaagtttttcttaatatctctagtctctacttctggctcccttccctcagggtattatcccctttacaaatatttttttgtgtctttaggtttccatttgttttttaaaaatacattcttatcaaaacgggaaaatattttcccatttctttcataaaccatgttttctcaatagttatctctaatcaaatacaagaaacagggaaataggtagtgccttacaaaggaattttagccatatacgtttggataaggtgaattttccatatcctggagatggttttgagtactcaggaggctacatctgaaaaaaaatatatagttattctctatctgggagtcaacttaattcttttgatggaaaaatagaggctgtgaatccccagctccagctggcagagatcactttgctcagaagttttgcacgtaaaaagaaacttcttttctgggatcactgatttatttcagctgtaccctgaaactggtagtcagatacaccctgtaaccagcagatctgatattctccagccttttcgggcttgtacatcaatcgtttaaactacactataatggggatcatttgccaaagctcattgccattctcttctagtcataccaatttataattacttttctctcaatatgtacccacgactctcctttcttcacccttatgatatttattcaaatattaaatgttgccctttttttctacctttattccaaatgccttagaggtctggcgtaaactatatggctataacctattgcatttttaccccatagatggaaaatgtattggtgaattgtttataaggttggaagttcccctgaaaataaaatccacccaccccactaggggagtacggaaactatatataatatgacacacatcgctattacttttattacatatgcttattatttattgttcaaattttcaaatatggtcctgcacacaggcaattttcacaaaagagcagtatcagtgttaatcagtttgaaacaggaaaggatttgtgaccccaccttacaaaatacaattccttatggttacaaaatctcattcaaatggattctattgtagccatatcaataaggaaactgatctatcagccaaaatcggaaatagccctgataaagtagactgagcttacattcatgcacagatgtttgctcattatttttacttgataaggacagatacgtttgtgtttagcataatgcgtgtgtgtatatttgaatagattttctagaccctcattttagttctagtaacaattgtctggttctgaatagggactttccactttacagaagcaggcaaaatttaatttgtcatagctaccactgaacccatttcctttatatactcaatctgctttgacacagtagatattggagtttcaaaccttaaaatgaaatacagctttatgatgaaatataagttgatatgaatactttcaatatacctatattctatgttacactcagttagctggcatttggtcttcactcatggacattttaaaaactcatacattctttagtgtttgataatgtgacaaatcaaccccctataaaattaactttaaatcaattgatacgttagcatgtgagtatatgtgtgtgactatgaatacatacttatataagcacacttatatgcttatacgtttgtttgaatctctcactgaccttagccataaaaacacttttattctgttgatttatacctcagcctacatgtgaacaaaagattcagcaaatcagaataacacagttactctattttctaatttatttgtaataaatatgcattacctgcataacgtttacatcaatatgggcatacattacttatgcaatgtaatgatctaaataacgcaactatcgacagtaaccacgcactctccccctagcaattacagaatacagtttctctgttgcacaacatgcctgactatcgtaaatttagggttatctccttattaggattccatttacactcttaatgaatcatatttattttatagcagcttattagtaaagttgactgccaagatataggcaatacatacaatttcctcaaaaactggggctttcactgttaatttaacaaacctatatgaatccatataatatatgaatcatatgaatatatataatatgtaataagataaaatgcataatttaacatatatgaaatatatatagtattaattgttaatatgtattaatatagtataaaataatatatataataaatgtataatatataatatatgaatcatataatagaaaaatatatgcatagacttgagttaggtgtaaagaatggaaaaattaaaaaatagtgcacttgatgagttcacaacctagtatagtgtgtcatagagaatgtagcattttgtgtatgcaatagtaaatatatataatgcaaaagaaatgaatggttttgcttagggtaggaggaatggggtaatatttgagataaatctcaaagcatgtaaagatttatcaaatgaagaattggggttatggaggagtaggggttgcattccaggagggagggaccaacatgtacaaaagcttaaaggaatgtaatttcatagtatctgggaaggacaatgggtagctatatgtttctgaaatcttgaatgcttgggtgaaataccaaaaatagggctagaaaagcaggttatgattagattgtgaaggcatttaaaagcgtcttgattagttgggaaataatttctacaacgttttagttgtataaataacaaaagcttcttttaatccagatacttagtggaagttcctctttctctaagtagaatactagacctaataataataataataataccgtatcatatatttttattacttttttggttttctgactactttcaagtacagagatggtccccgacatacagtagttcaacttaacaatttttcgactttaggatggtgcgaaagtgatactcatgctgtggaaaccatactttgaggacctatacaactattctggttttgactttcagtatagtatttaataaattacatgaaatattcaacattttattataaaataggctttgtgttttatgatttttttcccaactgtaggctaacgtaagtgttctaagcatgtttaagataggctaggctaacctatgatgtacagtctgttaggtgtatcaaatgcattttcaagtttcaaaatttccaaactatgatgggtatatcagcatgtaacttcattgtaagttgaaatgcccatcaaagatagactggataaagaaaatgtggcacatatacaccatggaatactgtgcagccataaaaaattatgagtttatgtcctttgcagggacatggatgaagctggaaaccatcattctcagcaaactaaaacaggaacagaaaaccaaataccacatgttctgtcttataagtgggagttgaacaacaagaacacatggacacagggaagggaacatcacacacctgggcctgtcagggggtggggggcaaagggagggatagcattaggagaaatacctaatgtagatgacgggttgatgggtgcagcagtccaccatagcacgtgcatacctatgtaacaaacctgcacgttctgcacatgtatcccagaacttaaaatataataataatataaaagaaaagtatctgtgcttgatgggttttgatatcctcagtaactatggccaattagttgaacatggcacagtattatccatttgcagtagaggaaacaaaggagaaaccagaggaacagtgagagagagagagagagagaaagctgctggtcatgtcctctttccagcatgtcaccctccatattcttcttcaaatcaaaaaacgtagaacggaagggagcttagtagcattcagctctgctacactgcacaccagctatacacacaggcaatcaatatggtttggacacagctgatataatttggtggagctctaattgaatttttccccttcttaatataattacacctacagaacgtctccaattaagtgtccccccatcagtctcaaaattaaatataccaaatggaactcattatctactcccacataaaccagctcttcatgactctttcccctttctattaagcaccactgcttccaggctcctatatctgaaatccctgaagtcgcttatttttgtattcctttctccatcccgaaatccattcagtcactgaatgctattgactaatgtttgaaattatatctatgcataccttcctttacgttatgggtaaatgtttttggaatgtgtttaaacagaacaaggaattggtgaacaaaagaataaagccatgcataaacaaatgtttattcaccgttttcattatatttgtttgtagtactgcaacctaaagtttgtaatgtctgagaatatctgattgtaagcaattaccccaaccccatgtaagttaacagtgttataactggtacgtctccttataggtgaatttgttcaaagttgcttaattatattttaaaaatctcttattttagaaagaactctcaattgctttactctgaataagataatactgtttagaagacaaatcattgcaagttttacatctgtaagtaggttacctgatgaaacggattgaaaaactgaaggcaaatattgaatgttagattattcccaggtatctgacttcatcttcttacttgctaggtgtcattgttaatgataatttaaaaaatcacacatacctacgtatccacatatacaaaacagtaagcagtcatgctattgaattcacaaatatacaccaaaagacaaggggaaaaatataaacaacagctttcttactagcaagcagagtgtggcgtgaggtcaaatttttatgacgaagagcatacatattcacaaagtaatttatctcaacttatgtagctggaaatggagttgatgggttctgaaaaaagcttctagatgacattaaaaaaaggggttcttatgacaaagaaaaaaattacctcaaagtagctttcaaagagatcgaataaagtcatttcatgaaatgcgagactaaaaaacatgccagcatttctaatatttctaatgttttatatgatataaatatgaaatataaaaatatttaatatttttatcatagaaaattaatggcatcaatttcttatcaaaatcatgcatacaattgattatatatatttgctaaagtcctaaaattttgtgtatacatgttggcctaaaatatttttgagggctcacaggcatattttcttttgggaaaatggaaactgcctaatacatgagatgatttatatacatgctgcattttacaagcggttagggaaacacatgtctattttttttctaaatcaaataatccgtgtgtgcaccatgctaccttgaatatcagattatcagatttaccatccctattagggatataaatgttccagaagaacataagagcaaatttttagaaagattaatacagaatctaaagattgaagggataagatgatttacattaaatctgtttccaggatatcctagttgggaaatcaacctaaatacccgaaaacttaaataatccaagacagtatgcatttgcttaacagactttttctccatcatttgtctgtgtttagtaagataaaagaaagacttgcggccgggcgtccgaggcagcgggtcacctgaggccgggagttcaagaccagcctgaccaacatggagaaacatcatctccactaaaaggcggaggttgtggtgagctgagatctggccatcatactccagcctgggcaacaagagtgaaattccatcaaaaaaaaaaaaaaaaaaaaaaaagaaagaaagaaggaaacttgctacccctcagtaaacaagttatatttccttcataactttcttcctataaggcaataaacaaatatttattaagaacctatcatgtgccaagtaaataagtactctgtcaaaacaagttagattcagagtgggctggaatgatttggacagaagggaatgtgagaaaggctagataagatggaaacttttctgccacaggcataccttcccagtagacgaagtagagatacaaataatgtagcgaagggtactatggaataaaaaagtcaataaatttatttatttagtgattacagctacgatttgctaagcaattaatatatgtcagacattaagccaagacctctgcagatgatgccatgtttagatcttataacaacctagtaaatgtgttaggatgatcaaatccattttattttatttaaattaaatagttaattttaatggatagaaaaaattgtttatctttatttcattcaacatgttgttttgaatatatatatatgaatggctcagtcaagctaattaacatatttattacctcacatgcttatttttttgtaggaagaacactttttttttttttttttggagatggagtcttgctccgtctcccaggcaggagtgcagtggcttgatctcggttcactgcaacttctgcctcacaggttcaagcgattctcctgcctcagcctcctgagtagctgggactacagcctcacgccgccacatcctgctaattttttgtgtgttttagtagagacggggtttcactatgttgcccaggctggtcaggaactcctgagctcaggcaatccgcccgcttccgcctcccaaagtactgggattacaggcgtgagccactgcacccagccaagtgaaaaacacttaaaatctactctcttagcaattttcaagagtataatacattgttatgaaccacctgtagaatcaacatgtacaatagatctctcgaacttatttctcctgtctaaatgaaattttgtattctttgatcaatatctctgcaagcctcacaccctcctcccagtctctggtaaccactattctactctctacttctatgagcccaactttttagataccacctataataagcgagatcatatgttatttggctttctgtgcctggcttattgcacttagcaaaacttcctccaggattatccatgttgtcacaaatggtagattttcttctttcatgtctgaattatattccattgtgtgtgtgtgtgaccacattttcattatccattcatttgttgatggacatttaggttgaatccataccttggctattgtgaacaatgctgcaatgaacacgggagtgcacatatcttttcaatataatgatttcatttctttgggatacatactcagtaatgggattgctggatccatactcaatttaaagatatagaaaacaagccataaatatttatgtcccccaatatccaaaagttaatcaatggccaaatcagcttaatttgtctgttttgtttttactatcaaacttaatacattcaccaatgctctttttcatagttgtagccttttcttgaagattataacgtttagtagtttagattgttatgtagacatgtggtgattaaagtaactcctgcaattaatttaactaattttagttatcatgtactacacttttacatactatttccctcaaaaatgttaaaaagcctttcttaaagcctttttagcagtgccttttatatttattcgtgttactgtttcatcaattgctttagtttggtgacagtttcatgtagttcatttactggattcaagttacagtccagttacttgaggggcccaaaagttaaggacttctgaaagtgcgtgaattgcttctactcactgatgcatcccaaacattcagatcttgttacctgaatcaggggttctattctttaaagttccttggaggatactatcagaatgaaaagactcaaaatagaagtcttccggaatacaatgttgtggttttaaacttaaaagtattgccagtacaacgttagtatctactgaggtggtcacactcattccagcaggtcacatactgagaactgcataggctttgtatggtaggccaaaataactttcagattgagtccatcaattatttttctaaaaaaaaaaaaaaaaaaaaaaaaaaaaacccagagtttttgaaaaacctacttagtcatttggaaaaatactatgacattgaaaatcatattcctggaatccctaaacattattaccaaaaccatcggccacagagctgtcttctactttttccccaaccccactaattccgagtgtatctgttcttaatattcaggttatacttaatattccatcttaatattttattttaaacacgttttatgctaaaaatttacacatatatttataatgttctttctttggggatatgaggattctactgctgacctactgctgaagtactaaaaaatagtacttcagtgtgtacagtaatagggttgagcaatttattcatgtcccagccaatttccaagtatccacacacatttcattggcaaagtattcatatccactcatcagagtttgtaatgtaaactgtttctaaagaatattttctcactctttcagaggagaaaatcagtgtattttaaaacataaagctaataaattccatcacacagaaattaacttcaatagggctgtggtttgaaatatgttgtaatccactgaaggaactcaggtaaaactagtaggttagctaatatttattttttatttttatctttaagggacaagatctctctctggcacccaggctgaagtgcagtggcatgatcatagctcactctaaccttgaattcctgggctcagatgattctcccacctgcacctcctgagtagctgggacaagtgcacaccacgccctgctaattttctttttatttttcgtggagacagggtcttgctatgtttcccaagctggtctagaactcctggcctcaagcaatcctcccgcctcagcctcccaaagtgctgggattacaagtgtgatccatcatgcctggtctagctaacatttttcttttttcttatttcataaaattgagactcactttgcatccatagacttatggaaacattttgaatccagatgccgtagccatttttttgtttgttttggtttgtttttcaatatcaatagaatcttttgtaagcaaaagaaagcaaggacttctttaataatttctgatttttatcgtggcatttcctcactctcctcatgccagcatagtccaaagttgctatttgctcaacattattcaggtacttaaatgtttaaacttgatagtttttaatgcatctataaatttaaacataattctggaaagcttcattttctataattaaaagtgataatctatcttattttaaatgtatttctgtcttgggtatcttttcctaattaaaatttaaactcttattttacaatgagacgttacctcatttatttttcattaaacaaataaaaccagacaatccctgaaaaacctatgaagaattatctttttaaaaatataacaaatccatgtgatgaaaactatctttttacatcaccactacacagaaagtttttcatttttttatgtaatcactattaataaaatcatccatgtaggacaataggcaattatcgttaacacctatagcaaagcatagataaagttgattttttgtttttgtttttgttttttttttaagatctcacttctgttgcccaggctggagtgaagtggtgcgatcttggctcactgcaacctctggctcccggggttaagcgattctcccacctcagcctaccgagtagctgggattacaggggtgtgccaccacacccatctaatttttgtatttttagtagagatggggtttcgctataatggccaggctggtctcgaactcctggcctcaagtgatccccctgccttggcctcccaaagtattgagattacaggtgtgagccactgcgccccaccctgacaaagatgattttactttatcttaacctcatcctcataatggggtttgataattacatttcatattttgatcacttaaaattatttttgttagtagcattagtattttgtacatgaggaaaaggtgctatgtaaccatcaaagtacagttctctttctaacggtaaaagtggttgtgcaaaatgtagcagttaatgtctataaataggagacatagaattctatgtttctctcaagaagaatttctgttaaaatataggaaaaatatatcaattcatatttggtatttatgtagattatgttatagtactcctattttacttttgtaatttaataagggaaaactttttaaaatattcattcagtgagtaactttattgagactctacaatacagtgtaagatttatataccaatactacaaccattttactgacagaaaaataaaaatctagaacagtttcagaaatgctgcctttttatgctgttctccccaaagcaggggtccccaaagcaggggtccccaaaccctgggccccagaccaatcggtccgtgacctgttagaaaccagggggaacagcaggaagtgagccccgggcaagcctgagctctgcctcctgtcagataagcagcagcattacattctcataggagcgagaaccctattgtgacctgcgcatgcgagggatctaggttgtgtgctccttatgagaatttaatgataaatgttgtaatgtgcttgaatcattcccaaaccatctccccagcccaagtctgtgaaaaaattgtcttccacgaaaccagtccctggtgctaaaaaggttggggaccacttccctaaagcttagggggtaggtctaaatattttctcaagactcctctaagtaaacacataaaagcataattttaatgaaagcacttgtatattactgcaaatgtgatacctgaacttttgtttgcttgctttcttgtttgttagcttttgagaatacaattgtttttattacttagagagtatacattgaaggaaattataagaattttcatacttgaaagggacaaaagaatatgcaataggaaacagtaaaaaaaaaaaaaaatcatgtcagggctttcaaacctatctgcagaattcctttcaagtttcagtcctttgggggagccttttagctctctgcaccctctccttctgcttatgtgtaagccttggtgatgcatttaccaaacccttcatatctgtaatcatgaggtagcttttctccttcattgtaaatttagggatagtagaaactgccttatttaacattgtatctcttatataaccttacatgtaccatacatacatagagtctatgggataaataaacgtttatacaaattaaacatgagatggatgaagagataaacggatggatggatgaatggatggatgggtgcatggataaataaataaatggttggatgaatatgcttataattatttctatgtaaaatatttttagtgttaatgacccccaaagtgctcttaaagctccaattacctagttaattgcacatagtacaaaattcatagaggtaaacaaaaaagaacgcataaagaaaattgtttctcctattatgttagctagcctcctagttatcctccttctctcttactgggggtgctggcattgcggttttctgtgtattctttcagatatctgctgtacatacatgcgcatagtcatacacatggccacgtatatcagttcaaatctgtcaggaaggtatgagaacatcaatttcctcataccataaaaaacgcagtatactaccaaacttttgatctttgccaatatgattggtgaaaaactatgaaactatgtcttttagtttgcacttatctactcaggaatgaggatgaacatattttcaaatatttaagagcaatttttgttactttttctctgaattctgttcgttttctttgcaagttataatattccttccaaaattgttttataaccagttgacagatgggaaccagtctctaggtggtatcagaaacagtgttatccagcatattcaaacctaccaacttattcgatttatcactatagctaattgtttgagtagttcatacatttatttacactatcaagaaaaacagtttcaacattcttgaccatatttaaaaatgccttttaggctacaaaggtagattgaagagagaagttccaaacagtaatgaaggcctctattccatcccagggaatttgcaaaggctctttcctggacaaacttgtgctattattttgcatgatggaataattttcatccttcaaatctgtttaattgcacatccaaaaaaacaccttctttgactatgaaatccagactagttctctctccttccctggactctctattttaggtactttctatctgaacatcttgtttatttcttcaataacacttattatattgggtgattatgttattttgtcatttatttgctattccctacaatagattggaagttccatgagagtagtttccttgcatgtcttgtttactgttttatcttcactgcttgatccatagtgtggcatgaagtaaacattcaacaaatatgtgcggaaggaataaatgaacatacacatctaatttctggtgtgtttatcaaaaattcaattgtatacttctggtagactgaatttaattcaattgagtttttcccatgtgtgataagaaggatagggaaagggacagatggaggatgagagggtaggagagaagaagagagaaagagatgggagggaggagaatgtagactctccaaggagcctaggctttttactgcatttatttattcacaatttactgcaaatgaatttcacagacacagaaactgcaagcttagacaccatcattgctctgagacaaatgcatccagagtgtatttgaagttcagatataattgatagataaatgtaaagctgggagaaatttattaaaaatgattggtaactcataactttcaaggaagtgaattgtttaaaaaatgtacataatacttgggttagatactgtgtttcttagttaaaatataataatatatgtatttcaatagatcatatatgccaggagacacctgggcgtattgactattacataatagtgattatctttatccatctagtgtttgattgaggacggaggttgatgtatcaaattaaattaattgagatctaagaatgacatcaataaacaaaatgttaagtttcaatcttcctttttgcatatgtactgctttaatctttcggctattgatcaccagttatgtttgcaaagatcacatttaggctttcctttacagagagatttaacttaccctttaaaccatgagtcagtgcttttagttttggggatttagtttccttaaagccctctgagggaaagaagggtatatatagttatatatctccagagaaattgaatatcaaagtctatataacatgtaatttatcaatgattattaactcctgcacttgcctgtgactgcctgtatttggtgatgaagaaaatatagaaaagtagatgattagaatagggaacctaggaaataggaattggaatgtagataatctacagaacaaatggtatcttcttttatttcaattgtcatttgaaaaactttctttgaagagtaaataaaatataacaaatcgggactgaattcagtagaatagactgaatactactaaaacataaaaaataaaagagctaaaaggtaactttaaggtgtagctttatgttcttacatttatggcatgagtgcaaggaaaggctcaacagttacatgcatccatttactttatagttgaatagtaaaaaataatgcagtgaaaagtaatacttcctagggatgttcttagacatgcaacctgatcaaaaaagtataaaacaggttggatagtatctctggaatctcccattaataccaacaatgccttttcatcaaccaacactatttgccatagtcttctcaattctatctggacttcctgattttgatcttttcaagccaatccttttacacactgctctcagacttagtcatctaaagggtctttgatgatctccattgtcttaagttagaagtcctaagcctggcctacaaggttctctattttttgtcattttcctattttgacttatttcctccactctttgactgtcctacttaaactttaaggcagtctccttagacctggaatgctgtttcccactttctcaacctaccaagcttttgaacgtcctttgggacccagacaaaatctgatctttgccgtgatacatttcattaattctctgaggtggaattagtctccctttcctttgattcttctgtagcacctgtaagaacctgtacaatagcaggtatcatattgcatggtaattattttccaaatgtccttctcctcattccaattatgtgtacttcaagggccaggacattgaatcattgtgtgtatcctatgctggaaatatattaagcttccatagagttctcatgtaaattattgtgaaacatttttaatgctatgaagaaagcattttaaatctgtttaagaatacatgttgaccgggtgcagtggctcatgcctgtaatgccagcactttgggaggccaaggcaggcagatcgcttgagcccaggagttcgagaccagcctggacaacatggtgaaacctcatctctgcaaaacccacaaaaattagctgtgtgtggtggtgggcacctgtaattccagctacttgggaggctgaggtgggaggtttcacttgaggcgggaggcagaggttgcagtgaactgagatcacaccactgcaccatctgggcgacagagtgcgaccttgtcacacacacgaaaaaataatacatgttgaaactttgggaaggttttgaagcaagttttgattaaataggacttagatttcaggagtcagttttatcttcaatgcactcaaatttttcagataataaaattatttaatatacagtcatactaataatatagacccttgcaatagataagttggtgtgtatgcgtatgtccaacagaggattcctacagtcacatatattttagccataaaataggaaatctaaataagcacctttgtcttagacttcagcacaataggtcgaaccttcatttgaatgtgactagggactgccaagtccctactgcctatctctaccaaaggctgatctggaagtgaacccttttctttctttttttttttttttctagcagatgaatgttattgagtttatctgtggtctagtgatgatacctgcagagcagcttcatttttcagagtcattcagaaagctatcataagcttcttccttcttgtcaggcagagcaaatcctggcatgacaggatgtactgggagtctccgatagtgggaactgacaaagatgtgccttcagcactcccacaaagccatattgtctttctggaaatgaggaggatttattcagcaaatctaagtgtaaactaggagacccatcagataaaatccatacaacaaagatcaccaaccattttttcttcttctgaatagagccagaagatgcaatttaccttcttctctttttttccccagaagtgacaatatagagttagagagaaattatagagcggagattttgaaattcagtttcctccccaactaccagttgaaaaagcatagccttaggaaatgttctcatttgatttcctatgttttataacatgttatgtttgtgaatttgtgtgtgatgtgtggtggtggtggttccaaaatatctaagatatatagtaaatgagcaaacaaaaatagtttgtagcttttgatatatcatagttgtacatattttcgtgttacatgttgtattagttcatttttacacagctataaagaactacctgagactgggtgatttataaagaaaagaggtttaattgactcaaagttccacatgactggggaggcctcaggacgctgacaatcttggcagaaggtgaaggggaggcaaggcacatcttacatggtggcaggagctgggggatgtgggggggggggaagtgccacacttttaaaccatcagatctcgtgagaactcactcactatcacaagaaaagtctgagggaaatctgctcccatgatccagtcatctcccaccaggtccctcccctgacacaaggagattactatttggcattagatttgggtggggacacagagccaaagtatatcacatgtaatattttaatcatgtatatactgtataaatgatcaaatcagagtaattgggatatccatcatctcaatccttcctttctttgtgatgggatcattataattattctcttctagctattttgaaatatacaatgaattattgtttattatactaccatatactagaaaaaatgctctttaaacctcatcagaacacttgctaaattgtctttctatatgcttatgacaacagtaaaaaacaaagatcacatgtccaatattactgggctgtgcttggaaaaaaatattttactcttttttaaactttagccaattatatcttcaatagatatcaacactaatatcacatctttaaaaagtttctatgggttttagtaaggtatataaaaccatcaaatatattatccagagagacaatatattgacatttaaaatatgttcttactcatttatggtatcacctactgtcagaggtaaagtaaatttaatgatgtctaaagggattacagttgcttaaattggctagagttttatatgatttatattttcattcttttctggacattggaatcaagtagtaaattttgaaattttatattatatttttacttatcctgtttacagtatcacacctgactcaatttagagtagaaaatatttctagttacccttcgtcagaatataaacatcttttcaaattcatttcagcattttaattgtgttaatagaaatagttcaaaaatatagcataaacctcagcatgttctattttggagagaaggaggacaatgattgttgactctgatggatagtttcccaatgtgaaaagagtaaatttttcttcataataatattttatttcatttcatatggtactctaaaataggcaaaatatacctttacctctcttctgaatactagaagtagaagtaaatgattttattattgacattattaattatactatatttatgttgatatgatgccttacagttcatcaatcattttcatatattttaattcatttggccctaatagctgtgaccacctcccagaatagcccagtcaaaagaggttgaaaagaaaaatcatacaaaatacccatgaagtttaagaatttatggcacttgaaatatttgcccttagacaatgttcttagtatttctgagcctcagtttttaatacatgaataagaatactttaagtattattcttccacataatgggaataagaatacttactccatgaaatgagaataagaagacttactttatgtagctactgagggagtcaagtgaggaacaattactaatgccatgacacagtgtagatgctcaatactcatcattcagtttccccttttgaacttaaggccagaaagaagtgacttcagtggtggtactaaggagagagggggtgatttagccttcgcttaacattcatcagacctcacaccaagccacaggaagcaaatatacaatctctgaaaatagggaaacctacattcaagacaaatcctgtgtgtacctcctccccttcctctcccagaaaagatggctatgtctgaatcacaaaatgtaagcggtcgcctaaaaattcagaaatcaggataaattatattttacctcattttaacaattaaaatcaatgcaaaataattcatatgagcaaaatattaaaattttaagagaatacaagatgtaatcttgcattcgtgccactcatgttctctggcctcatccttatctccacttaaccaccaactgaaggactagaaagttggcaatgacataaagcacagcttcctcatgccatcttcccatgtccccccaactttgggatagtaaacattgcctgaatttataatcctgtaatatttttaaatgttttatcagatacatatgtttcaacaatatttgttccagtttagtgtagcaggtaagactgtgggtttcagagcatttccacctggatttgaattctgtctacactaattactggatatctgaccttgggaatgttactgaagttctctgagcctcagttttctcatccaaaaaaaaaatggggacaataatagtaaatatgtcatagggctattgtgaacatatgtgagaacattaaaaatatttactgtatgacacaaaatgttttagtttgtttttatatttaaatgttattaaaaagatatttgggactcatattttcctcatgcatcatcccatccctagaatttatcttgattgttttgtgtagcagtcgtttctttgactactatgtaatcaggttaactgtccattttcctgccagagggcatttgggctgctcgaagatttttcgtttattgtgttattttgggcagtgctgctaggaacattctcctcatgtttccttttgcaaatgcctctctgtttttgatgttgcagatggattttaccttgccatggcatgaaatccaaaggctgtacccacagattccgatatttatctcttgcttgtccacacctagtaataaactttagccaaagcaaactgttgcttgttactatgagcctaaagtcgctgtgctggtccctcctgaatccttttctatgagtcgcttagtactcttgctctcaagctctggtctgtaccgagctgacagctttttttatttctaggactttattgctgttttaaagtctttccactctgaatctgtacctattcaccccagagttagttgcatttctctgtgtctctaacctgagggtcatgagtctgactttgctcagtgaaggcaaatattttcttcctctgcagtctgtgttcattttgataatgatgcttgatggggggactaagcatccccctgagaggaaagaatctcgtttggattgtaatttgtcacagtttgtcttagtttggatttctttaaaagctaagcctgaggcgaggactagagagcaactagctcatttggtagctgatcacagggagcacaagtgggaggcaggggaagtaaggaaaaacgggggaaaacaatagtgagtgtattattcagctggctactgcagtgggaaactgttgttcaatcctgtgaagacccctctgaggaatgctgtagaatgtactcataattgtccctctgaagaataagaggctggggaatatgtctctggttcctgtgcctcattaattatttctcagggacatcaggtcccctcctgtgtgttggatgagtgagtttctataactttggacaaagtcgtgaggctgaaacacagagaagcagtgggtgcttgacctggtgggctgttagcatgcccgagactctccattacagggctgatcaagccagaggtaaaccaacagagtgggcagtgtctgctacacagttccaactggatttcccaattacctagtgctatggtcttctttgacaacgtgtctcaagaaggtaacctgtagctctagcccactgctactgaatgtttcatacctggtatcatgtggattataactgtagtatttcatttttcaggtattgtagtatcgaaaagccctatagcctgttttccttagtataaattttgattaaattatgcaagtccactttaaattcacagtttgatgttatgtacttaggaggcactcaataaatagttcttaaagcaataatttttaaatgactttttgtattatgtagacacatattaactataatagagcccttcggcaggaaaactgtttcttcaaagttgcaaagtgactgacaacgatatatataactagaagcttcaagaaaaatgttaccaggggccacttttaaactagggggaaaatcgtttttcacaataagctatcccatctcctccctactgaagcctctgatctgctatgattattaaaccctcatcttttagtgcaagaaacccagcaagctgaaagggaaatgcttttcagatttaaaaaacaaaaacaaaaacaaaaataaacttaatttcttttaggttgatgttgttatactaacttgccaatcagttaaacatgtatctgtcttttaaaaatatcttattacataagaacaaaagattttaagacatacagtttcaatcataaccaaatgtgtttattacttcgaattttccacagtaacttgaagccatctatgtacccatctccaattccatcgcttccccactaccaccagagataacggtggtcgtgaaatttgctttgttttatagtcttgctacatatatatgtattactaaaagagaaatagtcttgctctgcatgcttttgaacttcgtatagttggaatcatattgcatttattcttctgtgactgtttctttcaatcagcattatgttgctaagattcatccatgtctgtgactgcagcattatgtcatattccgtcatagaaataacccacaatttatttatgcatactactgttgatggatactagggtcgtttccagttttaattcttttcctattacaaacaaggttccttgtatacatgtaggagtgggattgctgggtcacagggcccatgtatgtgccctctggtatactctttggctcctttacactgctctactgtgtaccactgggagactgacctttgtagactgtgtgtgccaggcttccatttccaggtgacttccagctctctttggctgatggtgaaggattggaaactcagggaagacacaagagtgcttctcttcctctctttgtgtttcaggcagtatctttggcaacagctgcatatgctttgatgtcccccctccaaccagataggcccactatagctgcagcttccaatgaatgatctcataacctcattcactgaattcatgcaccctgccttcttctttcctcctcctccccattccttctcctcttcctcctccccatcctcctccttctctctctctctctctctctctctctccccttctctcccactcttcttctctcctctcccttcctctccctgtactttaagggtaatagtggcttcctgtggttgctaaactctgagtcactttgtcctccacagcttgtcaactctgttcttctctcatttgtttcaattctataatttaagctttctgatttaaatatcaaatgactttttgtgtctgcttagattctgactgacatgatgtatttctaagtttccaagattatgccaaattatttttaaaattggttacaccaatttaaattctcacgaacttaaaaattctgcttgctcccaaattctaacacttgacaatgtcaaacttaacttttggctactctgttgagtataaaattgtttctagctgtggatttactttgaattgcattaatgaaaaatgagtttgggcattttttcatggttccattggcaagttttaaatgcagacaattgtttagaatacattatttttatttaataaaactcattattaaatgtatattcctttaaggctgtactttgatttagtgtaagtagtacacaatttacctcagttttccgttttatgtattcactcatttaatttagcagatatgaattaagttctacaatatactatacagagtttaatgtgaaagtaagaaatcagaacatgttatggctaggataacttgggagcacagccttttgaaactggtttagtgttaggatacacatttttgtgtttacctctctttcccaccgccagtttcaccatcattcataagatcaatgactgtggtacattacaaatataatgtgaaattgtttacaagatttagtattgttcaatcattttgcaggcactatcatggaccttcagtgtcaataaaggattcagaggttccagaaaattctaggctatatcatgccttgagaagtcctatctaataaatatatagaccacttttagagtgtaaaggaattcgtaaaatgtgtcagcttaaaatattgaaatagcgagggtgacttttcctttccaaactgttgatgaagactgcagacagggataaacattagctctgtgtggacaggatagtgtctgttgtctgagattctggtcatactggtttaatacccataattgaaagagctctaagacatggctttgtggagaaagaaagatactacttgagagaaagcaagttcatatttccttttactaataagtgttcagattcctaaaatactgtaacagtaaaaagatattttgaaactttctaagaaagtgtgttctagggcggggcgcggtggctcactcctgtaatcccagcactttggggggccgaggcaggcggatcacgaggtcaggatttcgagaccagcctggccaacatagtgaaaccccgtctctactaaaaatgcacacacagaaaaattagccaggcatggcggcgggcacctggaatcccagctactcaggaggctgaggcaggagaatcgcttggcaggagaattgggaggcggaggttgcagtgagcccagatcacaccattgcactccagcccgggtgacagtgtgagactctatctaaaaaaaataaaagaaaaagaaattgcattctaggggtgaacatccacatgtacctgggatcaatccttccacagtcatatcttcacatcataattctaaccctaaatcatcaagaaaatattatgttagacataccatacataagaagggaaagagagctgtcctacataatcattttcatgtaaacctttcatccagaagttgaggtgttctgtcatccaaaggagtagctctcagctgtctggaaaacctttttgttcagaaggacatttgttgtgctttggtttaccttgggttttattgtgccgcgtgtgtgtgtgtgcaattctcattctattaaattattgtgtgattttgatacatttatgtcagggattagaaattttagaaatagattatttctggttttctgatcaatgtgtcctgtctatgtattttgtctttgtgcaaaggaataagactaaaacacaagttatatgcctgagtctacaactgagtgttgtaaaccaaaattccaaatgaaagaaagatatggggtggatggcaggattagagaattgaaagagtgaagaacaaaaggcttgcagacatcagtaaaatatgctttcttagttaaaaatagtaagaatgttttggaatattttacattaatttcgtttcccactttttctttacttttgcacaattaatgatttagtttttgagtttcaaatatttggccaagcttatctactgattgaattcaatttcttactggatgtgtgtactgcttttttgttgcattcatggcataaattttgtggacgcatttctacaaaaaccgtggattcagcatgttgcagagtactatggcaagaaaactgagtaacagactaagctgagacttggtagaaaatatctgttctcctacaaggcttgactctctactgttacttcaagaaaatattatgttaactatatgtgttatacttaagaaggcagaaggatactcactcctctgacgtggcgagatactcctcattacccccacggaaatactatctagattgtgaactcatccatagaatgactacatatgattcattttgtgatttccctaatatgtattgagtttaaactacattgaattccctggagtttgactagaaggttgattatccagtagagtttcttgtaagaaattcttatagcagtgaactattctttatggcagataaatcctacctgtgtatactgattttctttcttagtaccatagttatactcaggttactttttttttttttttttttttttgctcatatagacaagactacataatcctttttagaaagggccaatatcctatttggaataaaaacaaaacagttagatggtaccagggtcaccttaaattaacttatcagactatcaaccaaatcgaaatatgatttcagatgtaattaacccatttgcctagtgagatgcaaaggtgtgaggatttcttgaacacatctttctcttatgtagcaaatatcaacctcctgataccttttgtagtcagttcacataccatgacaatacatcctaaattttcaggtgtgatctaaccagcataggttcacataattggcatgacacggaatttttaaaatatcaactacctcaggaactttattcatgtgaatctggaagatcctttttggtatttgagccctttcatagattcagatgtcaaagtatttttagaatgggtctgtaaggcatcattattttgtaattataatcttattgattgacagcaaatgctgtgttccatgaaaatgttgcattgaagtgatcccggttagtgctaaagacagactgcttagatctaaagtctcatgagaagaaagaaagaacttaaaatcattttaaattcaccaatatgacgatacaggatctctcataaaatgctgaaaggttgtttttgctgccagacttttagcacttccgttttacgttcaaatgttgtaaaggttgattactcataagttaaaatgtttggtgcaaaatgtactttaaaaatattttcagtgttttttggaaattgtagacatttgattttgaaaagtaggccagaaatttggaagactacaagccatatgatggctgatatttcccatggaaaatataatatgcagctgtgctctgctgcatggtagaacaggagattaaaatatgagaaattataataccgtttgatgatgatattaatgtcactgaatcaaataaagtatgtgatatatcataagttaatagaacaacacttaattattgattagagcctacatcacattttaaattatcggcatgtttggtcttgcaaagggtcaagggtgactcgtagcaacagaactattctcctttcaaaaagttagcagaaagttaatatcaaattctatgaggtagagagggatttgggctgaggtaggtcaggaggaacgtaaagagatgtgtcatgtgtagatttgtgagctgtgggcacctgattttgtgtttaacagtatttacgaccaagataagtgaatgaagagctatgttcttatgaaccttaagtttattttgctaaaataagtaagaaaattcaaattcaaattaagctatatagtcttgcaaatttcaggtctctgaggggtgtgcattaataagtattcaaaagtattttgtcatttaattactattatatgaatttttatgtaattgaattattcttgaatgttgagaaactgtctttactaggctaaaaattcccttagtgatctcgttacccaattcctttgtgttccactctcagtgtctgaattgtcaccaatatgtggagtccaaattatgaaatacaaagctttaccagaattctgatgattttgaaggaagaaaattacagcaaattttgatcaattctctcctattagtgattaattcaatgaaccgcttgaatttcttatttcctcgtagaactgtatgtacatgaaggatagatacaatatttagtacaatctatagtgagatatgaagggaaggagattatgagaaaagaataaaactttattataaaaatgcttgttcataaagatttgacacaaaatcaatatgataagttttcagaaaatcaaacaatgaatttcgtatgaaacctcacattggcaaagcagttatgtgaataccaatattttttaaatctaaaacaaagcattttgaagtagtttcatgaataatgtactgaacctgtttcacgcaatgaaatgaacatcacagtgagaaaattattccacaattgtaaagttaagtgaagcttgcattataaggccaataatactcaatagggtattttctcatgaatttacactatagaatgtttttattctggaatttggatgatatcatagtcattcaacaaatacagagactaagtgatttttaaaatctttcaggaaattagttctttaatttcatctacatgtatgtaaaataaccaaacctatgtcttatgcatataatgtcattctaatatattgttcatgatcataatatttatatagaatccattttgcttggccgattgatttggcttggcctacaaattagtacagtccctctcaactttgacacttctgtgtaccatcagctccttcctggagtactgaaatagcatcctaactgctctctctcatgtagtcttgaccccatctataaatcctaatttcagcatttggagcaaccttttagaaagatcaattaaatcatctcacctcttcattaaaacgcctctcattctaccaagagtaaattccaaaccttttaaccttgacctacataactggaccatgcctccctcgcccatttcaattcagctttgctcttgtagctccaggcaagctagctctgtcttagttcttgcatgtaataagctttcaagtccctcggtgtctacttatttactgttccctctgtattagtccattctggcattgctgtaaagaaatacctgacactggataatttataaagaaaagacgtttagttggttcacggttctgcaggctgttcaggaagcatagcagcttctgcttctggggcggcctcaggaagcttctaatcatggcagaaggcagacggggagcgaggtgactcagacggtgggagcaagggcaagagagacagcaagtggggaggtgctgcacacttttaaacaaccagatctcgtgagagcccactatcgcgagaacagcatcaaggggatggtgctacaccattaatgagaaacaccgtgatccaatcacctgccaccaggccccacctctaacattagggattacaattcaacatgagatttcgtggggacatgaatttaaaccatatcactatctgactggaatgtgctttgctcctgcttctacttccgttttctgagcaatcagacagttattcattaactcattcattcattcactcactcatttgttcatttatgtattaaattattcagtgattctcaactctgggtggttttgccgtccaggggttatttcaccatgtccggagagattcctagtggcataactaaaagaagagatgtttgctactggtgtctagtgggtagagaccagggatgttgctaaacatgtaataatgttcaggtcaacccaccataataaagaatcatcttgtgcaaaatctcagtagcaccaagattgagaatctctgcaatacgtcaacaacccttctaggtgccaggaatatgacagtgaaccaaatgaatatggtctaaactttcacaaactaatccattaaggagaagatagtcaataagctggctaacaaacaattaaatgtatactttcaaattatgttgggtgctctcatggacaaggggacaagagagtggccagtgaaacctaatttagagcaggtggtgttgggggaggtggtgtttatgctaagacccaaagaatgaaagaaagactcagccccaacttatatatatagtaaacatttattgaatatcaatagcaaaaagttgcatttttctcaaccatgtctttttatggtaactggaaattgttcaaattattttttagaatcttttaatcatagattctttgctaaggggattagtctagcatttttctcttgtgagcaattaagttctcaccaagttagtgaatcctatgtcttatgtacttcctacttattactatgaaattatctaaaaaatgctcatagggttcctaatgtagttgaaaagcaaactgttgctgcatctctaatcagtaacaaaacttgtatttctgtcgcaaaataatgtaaaattttatagtactttttacatatttatttaaaacaattttaagtaagattgtttctttgtggaaggtcatatggtcccaatatagggatgtgtacagaaatacatatatacatacaacaacacaatgttaaacctagcaaaagagtggagtctctttcttttatttttcttactttttgagcaacgagacaagcaacatattatgcctagtcacttgaatcatacaccattaaaacattatgggctgagtgcagtggctcatgcctgtaatcccagcactttggaaggccaaggcaggtggattacctgaggtcaggagttcaagaccagcctggccaacatggtgaaaccctgtctctaccaaaaatacaaaaattagccgggcgtgtggtggtggatgcctgtaatcccagctacttgggaggctgaggcaggagaattgcttgagcccgggaggcggaggttgcagtgagcagagatccgccattgcactccagcctgggtgacagagcgagactccatctccaaaaaaagaaaagaaaatatgaaaagaaccatttttaatgtcaactactgctttgatgctaatgtctgtcagttcagtgtctatgacttaccctttattctgctcaaaaccttcttgaattttccatttgaatatcccacaggctcttgaccccacttatccaaaattaaacctatcttcctctctactacacctcttcttataatctttctcttgctatttctaaacatttagtgggccaaataaataccctaggagacatgacttgaaaggggtatgaagtttagataatgttcggcttcttgatctgatactggttaaatgggtgcattacatttgtgaaaacttattgagtcacttatgacttacagattttctctatatattttatattttaagaaaaaagattacatataaattctagaagccaagctacacctttccctcttattcatccagcacatttactgagacagctagattttcataatgactgtccattgttgaatatttgctatatctttgatattgttatccattattaacttccttacctggtttgacagttgaaaatttctgtggtgcagctattattatttccatttcacatatgagcaaaaagagacttagagtggttaagtaacttgtctaagttcacacaacaacaaagtggcaggagtagagtttgaattcgagtcaatatttataatcactatgatatcttgcttctcgtgttccagtcgcattaaaactatgaatgccactcccactccttatccatccttactacctggcttcactttagatcttcaggtcttctttcctatattataatgataatatcataagaaatccagtgcagtttagtctattccaaaatcagtctaaatactgccaggattagtgttcattccacaatataaatctgattgtgtagtttacttaaaatccattaacacagccgttagcaaccttagctacatgtgaaaatcaccaggctccacccaagataaattaaatcagaatctctgggtatgagggactgggagtgagcattttaagaaagctccctgggtaactgtaatgctcagctaggcttggaaaccaatgctttaacgtttccctacagcttttattataaaaataaacccctcagcattgcacaaaatgccctttgtaatttggtttttgccttcctctacctcgcctcctctgctgtaattcccttcttctcccactttttccccaccctacctacatacatttcattgcaattattcaaaagtctttgtttcttctgaagagttatgatttttataccatacccttacacataccagtcttcccctctaaatgcttagttacattatctttgtacttaatccttttagttgctgataataaatgaaaatttctttttagtttctttttttttttttttttttttgagactgagtctcactctgtcgcccaggctgggctgcaacctgggctgcaacctccgcctcccgggttcaagggattctcttgcctcagcctcctgagtagctgggactacaggcatgagccaccaagcccagctaatttttgtatttttagtagagatggggtttcatcatgttggccaggctggtctcaaactcctgacctcgggtgatccacccgccttggcctcccaaagtgctgggattacaggtgtgaaccaccgcacctggccaaatttctttatagtttcttgacttgtttttaatttagaaaatttcccacgtatatagacaccatacaatttataatgtaaagctgttttcctatatcaatcatgttttaccttttttctctttctcctatatatgctgcttcctggaagatctaggagctgacaagtgtctttttatcttgctttgcaaatctaatcttttgccatttctttttatagaaatgaaagcttgtatcatgcatactaaagatggcttcttctttgggctgtagggccatttaatgagttatattgaactgaatgctttataagagttcaaattagtacattgggatactcctatgccagggatggattaatatatctgtccacatatatacacaaaaatgtgtgttgctaatttccaaattagagaatacttattttgaattatcagtatctatgacatattttgcatgtggtatatatttggttaattaaactgagttaccacttgttttatcaaaatttggtgtctttctaaatatatcatgaatatttttcttctaatgcacctcgctttctgctggaactatagaaacactttgtaaatttttacttgtgaccactcgaacatttacaggacattttacctgaaaattttttctgagtcagtgaagaaaatgtccatgtttctgcgtgtgtgtgtgtgtgtgtgtgtgtgtgtgtgtgtgtgtttgtgtgtgtgtgatgcttgcttatgaggaatttattttggctatggttctttattttgctattgcactcttaacattcgtatgatatgtattattaccctataaatacttacacaatatattcttacaaaaattaatacaaagattggccaaaatgtaatagcatatgtttttgtaaatagaatatccatatacagtcataataaaactgaagagcgattttatacttttccataaagccaaagattaagggtgtaatcactgcttataatttactaggaaactataaaacagataaaagtagatgaaaggatattacaaatatctcaataagtcgtcctccgcaactgaccccttgctttacacatgttcagacactctatactaaactctgtttatttttctattttataattttctatatgatcgtaattcagcgttttcctataatattattagtagtgctaccaacagatattacattttatgaaaaattttaaaaagggcacatgttgcataaaactaggttttgaaacagctgcttataatgctgatatttagcacatgactaggtggaatatggactttttaatgaatattttttcaaagttaggtaatttctcatcagtcagtttcaaaagcaaagttaaaatttgtgtttcaaaaaactgggtatgtttgaaaattgtatttaataatggattttgagagttctcaatagcaaattgcttggctgactgtagtttaagaagtaataattttgaagagaagttgaatgcaggtactttcaaagtgttgaaatttttaaagaagaaaattaaccttttcagactgtacacttgttcatcttttatattcttttccctttaaaaaagaattgtagtaagaagggagattaccttctgtcattgatacaaattttccacagtataaatgctgtttatcacatttgtataatatacacttcctatcaattttaaaaattacatgttactactatttaactctgacttaattattttaaatataaaataattcattcttttataaataatcaaaactatagttttacttttctttcaaaatataccactgactacattacagattagattttttttagtataccaaacatattttcatcttttggagttattggaagagtagctgcttactgccttacattttagatttctctatataacaagcattttcatcattttggcttattcgagtaattcttaataaataataatacaatatttacaaatgagatgtcatttgcaattttaacacttcataattttaacaaaatatctttactttgagttttttactttccttttggtgtgacattttgacctccaatgtgatcttcatttaaaggaaatatcaacgaaaattccttttttttcatttgctatagatgtacatataagatttacatgtgtaaggaatatagagcaataatgaattgagctattcctcataatcacttcacttaagaaatagggggctgggtgtggtggcttgtgcttgtaatcccagagttttgggaggctgaggtggtaggattgcttgtgtccaggagtttgagtccagcctaaccaacatatcaagacattaagtctatgaaaaaattaaaaaattatctgggcatagtggcatgcacctatagtcctagctactcaggaggctgaggcagttgaatggcttgagcccagaaattcaaggttagactgagagctatgatagtgccactaaacttcagcctgggaaacagagtgagggcccttctcttaaagaaaaattgactagaatatgactaatactctagaagccctcctccacatgccacccttcccaaatgcaccactattctctcttcccaattttcatttttgtatttattattcctattcataccaacacaattttaccagatgtgtatgtattttcagcaaatatttttagtttattatgcacttaattgacactatggaagaacagcttttaagatattattccaacttagggaattttaaggaaataagacctttgtatataaaaagttaaataggaataccgatttgcttttgattagtgttaaatcacataagtttaaatttgtaggagatcatagagatcagaaagcccagtggttcacaaactttcttttttttatcaacaaaacctcttttaaaaatatatagcataaggaagacggaaccataaaactgaaattacagcagctcaactgaattgtgagtttcaactgaactcaatttcaaacccacaaataagtcaaactcttactttactgagaatatatttggaccacacagagtttaaaaaacatgtttaaatttatttagcttatttataccagaaccaatataagaatccataacattctgcattagaattaagtacaaacactttttctttctttctttttctttttctttcttttttttttttttttgagacggagtcttgctctgttgtccaggctggagtgcagtgacgcgatctcggctcactgcaacctctgcctcccaggttcaagtgattcttctgcctcagcctcctgagtagctgggactacaggcacgtgccaccacgaccagctaatttttgtatttttagtagcgacggggtttcaccatgttggtcaggatggtctcgatctcttgatctcgtgatccgcccgcctcagcctcccaaagtgctgtgattgcaggcgtgagccaccgcacccggccgtagaattaagtacaaacactttctatgatattatactaaattaaaaacaggaactcaaaatgatacaaactgaactgaaataaaataaaataatacagtgaatggagtccacaattaaaatacctgcaaggacctgaaagggaatggaaataggtgaagcaaagatctaaatgcatacggacattgtgtaaattggaaagaatactggcaaatggcacgcctgtgcccagtctaaaatgggcaactgctaatcaattcagtctagcagtgtccatgtcagaatgtagagctatttttggccatatattttatttttcaagaggaacttaagaatctggagttgtatgtaaaacatcccagtgcactatatatttgcctcataagttgagcacttttttttatgtgtgcatgttgtctactggtgaatcccaagcacttggaacagtgcctgatatatagtaggcagtgatgtatatttggtgggtaactggaaaaaggttttccaattaaaaattctgtgcaagcctgaggtaggagttgggcaggacttatttcccattcccagaggataaagtgaagaaactggcaggtaccagcaggcagcgaccaacggaagtgagaaaaacagcagaaaccagcagatggcaacaaaagtgatccccagcagccctcattgcatattagcagaagccactcccaccagcaccatgacagtttacaaaggacatggcaataacccagaagttaccacccctttcctagaaagttctaaataacctgtctctcaatttgcattaatctgccacttaatttacatgtaattgaaagtgggtataaatggatataaatacagtagccagcagcccataccctgccaactttggaggcactgcctatgagttgtccctatttcacaaagcgcagtaatgttcactaaaacatagctgtttaacgccactggctcgcccttgaattctttcctaggcaaagccaagaatcctcccaggccaagccctgattttggggcttaacctgtcctgtatcaaactagccaaatgtatctcaggcctgaattagatcaatggctaccagttcaaatcttttgttttagatattagagaggcaggaagtgactctctactgtgtagcatgatactcagagcccaggaacttcttcagaatcccagtttgacttccaaaacgccagtgtcttgcttttatttactcttgtgggtggcagtaagggaagggagcatatctccttagcaaaacatctcatcagaacacggtccatagcacaaattattaattaaagacttacgtggaggctcaaatatagagccaaagcataaccatttaacaattatccttcaaagcaattttattcttggcttttggtggaaaaaactcttaaaaataaaatgataattctacatatgggatttgtgatgctatttagcaaggatatgctttattgcctgacatcccctttattttggcagaatactatgagattctcattacgtttccatttgctgcggaaagtggagaaaagttcagagggggaagactaattaaaaaaatggttgtctactaatccattgaactaaggcttcttaacagtcatgctcttcttaatagtatgaacacacattttgtattgattgcagagaataaagaaaaagaaatgacttgttttgaacttcaaaatggaaaaaatgaatacaaaatccagataagcctttgggcataccaactttttcgacttgtattatataacaacagttggcaaatgatttcaagttgctaaagcatagaaaatgatatttatttgatgaaagctaataaatcagacagaacaattaatggataatttggattgaacaagtatgaaagattccaccaataagaaccctcctacctaaaactatgaggtttttaaatgaaagactctcctaatgtcatagattttctctacctgtgctttatctgaaaataaaaatcacagcttttcccttcacctcttcattctctactcctccttatatttcccctttccttcttccttccttctccttcctttactctttgttctttttattcctgtttgttctgattacctgtgatgttttctaaaaacattaaaattttggtcaccattaatattttttacaatgaattaagaaatttatctcagaaactggatttgaaccaaagccttgttttgaacttctaataagtagactgaggaacaagcacgattttaagggcatatttaataggcaaaataaaaaaaacgcataaaatgcccagtcgttgatgaaaaaaatatatttttgtaattgctgttattcaggtgcttgaaggcccatgttaaagtatcactggagaagataaaaagcatacttcctcaatgtgaaaaccctcaaaagaaagggctataaacactttgtcctgaatatttgttgtttcaattgctgacgtttaacttttcatctgacagcaattcaagttctgcgtaccacagtgttgttgaatctttgaatctgaaaaatattttccttgcagctgtgataataatgtatctcctgataatgcatttaatgtggcaaagacacttttcttaaacacagtgaaaactaagtgttcattttgtcattgtaaaatgagacatgtttagttgctccaaattttaacttgggtaaccttgagacatagttgcacatttaacatcctatattttgcttgtcttgcagtcaagtgaattatcttagttactggagtgttacgtgacaccaattgttttgttaccactgctttaaaaatagctctatccctagaccccatcagtagtgtgtcttttagggccccgatttttttctaatctataggttagccctcaaggcaacgtggcctctttctgtttacttctcattattcctgtaattccaattctacatgtgactctttgctttattttaaaacagttgtgcattgctgatgagccttgaagtcaccaggggtggctggtgtcaatagtgagtctgtacatggctatttttatccataaagcagtttactttctgtatgatgaaaggcgttaaagtaaaacctgcctcctattataccctaggggtgtaatcaagagggatttgatcatagcataccaattaagcaggctacagcagactgctctgggttgtactaaggagtagggtgttctccacagatttttgaaccctttattgcaaaagcatcagggcacagcacatctaattcttttcatcgcacagctgtgtacataaacctctgtatacagtttctgctcagaggctgtgctcttagatttaatttttcttataagtcattacagccgtgatcattcatttaaacctcggcaagataagcattactagttcccagtaaactagatgatctcttcctctagactgtattttctcttatgaacaattataagattacaagactagcaatgttgcttatttacactacactacacacacacacacacacacacacacacacacgttcattccaagccagcagccagctcagcatccttgaaagctctcaacctcagccgaatatataaatatcagaattctctctaccaccctcaattagaaaatgttccagttctgcttttaaacttccactccaattcttcttgctaaggcctggaagcctcaaggtttcttgtattgccttatatacacctggattattcctctctgttgaaaactatgtcccattggaatgggagtgtctgaccagctggtgcccaagaatgctctcagaaaacgatcttccacaagccagagccaaaacccaaacccttgacccttatcaaccttgacgcccaaaactccaggtgtggattagcacagtaacccgcaaacccactcctacacgaaggaagatttttctagaacaactacagctctccttttatatttttgggtaattcagttatgatgaactgaaccagaagtataaagtatttgctcagttcagttcttaatctttgtcatggtattacaatactaaaccacttgctttgtcactttcatatagctcataaaagaaaatattactgtataaaatagattctgtagtccttcacttgttgttatggactgactattcgtgtttgccccaaattcatatgctgaagccctaacccccaatgggacgatatttggagatggaacctttgggaattaattagggtaagataagcacatgcaggtggggctctgatccggtggcccgtgtaaagaaaacaccagagagcttgctcttgctttgccatgtgaggacacaggagaaggttgttgtttacatatcaggaggagagccctctccagaacttgaacacgctggaacactgacctcggacttaaagcctccagaactgtgagaaaataaatttctgttgtttaagctgcccagtctatggtatcttgttacagcaggctgaaatgagtaagacacttgtattgtccctgcggttgacatctgactctgtaaaaacacccatgcatacacacacgtacacacaaaacaacaacataaccagtaagataggtaatcaagtatatggtaaatgcacctgattgcaataatgtgcgcatacccttagaatgaccctgtactgcagacacacctgaatgtgttttccgagctacggaatctgggagtagcccagcaagagagcccttccttgtctatgaggaacatctgagccccaagtgcatcccgtggaacacgggccatacatacagcggattgaggccccgagttttgggttggatgaaggttgccaggtgaacgtcattaagggcagagggttaagtaaaaatgctatataaactgcatgctgcccgcaagcagcgttggtttgcccgctcatcccaccgccgccatcactaccactgtgctgcgaggctatcttgtccagtctgccaccactggatcgtttctacaggtaaggcacttctcctgtccagcccaccactactgaattccctcccctgtatgtaaacctctaataaaacccaatgcctcgtttgctggctatgggtttcttcctcagtctcttgaacctgatgccttcgctattgagggttataggggttcagtacaacatcatgatgtgaacaaacgcgtttatttgggcagatgtattggtcagctctcaaaacaataatatcaagtaataatcattacctccaacttaatggttttaaatagcattaattctcatggtcatgcggggtttggctgacctaagttgatctagatttggttctgcatcaggctggtagttgctaggcttggctttcagcggcaggtttggtttggatttctttgatgtgtcacgtccagaggcacacactggaatggcaccggccacccagtgcatgttttcataggttgtcactagatagcaagcccaaacatgccagcccatctcaaggctctgctcctgtcatgttttcttaacaccccgttgaccaaaggctatcacatttcccaccataggctagatatgccatcctattaagtaggaatgagaaagtggggaccaataaatcaacctacagtaggaaaagtaggggattatttagtagcacaaacagatgagtttcagtgggcttgctgcttttttgtggatatggaagaaatacctaaaaaaaaaaatttccagctccactacaatatttaagaaaaaacttaggtgtgttcatagtttactactttgcttaataaccccactgtttatcacagcaaatttaatcacctctgaggggttttaatggctttgataagacaaagagtaaattactgaggaggaagacggtcactttcacatcctgagagatgctaactgtgcaaggtaattcacatatatcttgtaaacatgtttgcaaacatatataggagataggtggtattctcattttttaaggaaagaaatggaagacatgagagaatgagtaatatgtttaagaggacacagctggaaactggtataatctggctctaaatacgggcttttgtgttacattgaacagagataaattcagcttatgttaaggaagcatggggtaaaaaggtcaagaaactgaacaactgaataaccaaataagtaggcgaaaccatttggttactcagttgtctgaccaaccgaataatcaaaacaaaaatgtcacattagaaaactacgatcagtgtaattttatgaataattgaactattgagaccatagtgtagcagctgatctatcacgtcatgggattccatcattcattctcatgaattaactactctcagtccttgcttttagcattacctctactccctaatgatacatgatttttactctaacataaacttcccaggagaaaatgtctgataaatatcataaaatcatgaaaatatctgataaagtcatcatcctgcatcatgtgtgggagacttaagtttgtaactcttcccattcctttaagttggttttcagccttgcttacacgatcattgtggccagagagacagaatgtgccaagcgtgtaggcctgagctgggaaacaatgtcaataagtaatacagtataggggatgagaagtttgccaaataatacttggtgtgtaatgttatgaaagaaagggggcattagaggccgggtggctcacgcctgtaatcccagcacttcgggaggctgaggcgggtggatcacgaggtctaagagatcaagaccatcctggccaacatggtgaaaccccgtctctactacaaatacaaaaaaaaattagccgggtgtggtggcaggtgcctgtaatcccagctatttgggaggccgaggcatgacaatcgcttgaacccaggaggcagaggttgcagtgagccgagatcgcaccgttgcgctccagcctgggcaaaaagagtagaactctgtctcaaagaaacaaaaaacaaaaaacgaaaacaaacaaaacaacatggcgtggggggcatcagaaacacacaatggtacagatttaaaagctcctcgggtgatgctaatgtgtagccagggctgaaaacctaaaagaagaatgtgcagtaatgttgccagtactggaaggaagtgtctgagttttgtctagtgactgacagaaggctatgaaactgtaacagttgtaaggggttgagggaaagccgaggccagatcatgtggatcatgtgcaaattgtaggtaaaatgtaaagctgtgagttctgtggcctcactgaggaagcatttctctgcttttcaggaagtaacttggagttgagtgctctatgatttccaagttgtcagctaacacattgaataactgatgaattatggttctgtggccttcatttctgtgtcacgtggctatactgttcattggcatatgcaggcagtaacccccaaactatgacgcgagaggatggcaggattccaggtctgaagagaaaaaatgattaggctggggaagaatgatttgaggaacctcaaatcagactatggcagcaactactaggtgtagggcttcatgccatccagccttggagttgtcagttttctattaatctttgctaacaataaaatactaatgggtacataatgtagtgatttacagatgatagactctccttatgttttcattttgtctcaacagagtccagcatatttcatccaaattttactgatcagagaattgaggtacagacagaccatgaaggtcatgacagttggaaagtgttggagtagaataaggaagcctgatttttctcatttgtcctacatcgctttattagattgtcttctccagccttacctccccgccttataattcttgattttcatgaaacctattaaagggaaagaaaaggaaaactagaaaatttaatttagatcacttttaaaaatcactttgcatcttggactgttgtcataagttataggattaaatcctaatgattctaatgttgttaggccatcttaatttatatgatccacttacctctcagtcttctctcactggctcactcacctgccctctgtatatgaggggattgagaaaagtctgtttttcattatgtgtagatacacagactggtgtgtatgtagcaggaataaatgttcgcaaaactcagatgtggaagaagtaactctgaatttttgccctatttttgaactgtactccaggccagtgctgtccaaaagaaatataagctatatatgtaatttaaactttttgagtagccactttaaaaagtgaaaataaacaggtgacattaatgttttatttagctaaaatatttcaacatgtaatcaaaaaagacttaatgagacattttacgttagtgaaaagaatgtactaaatcattaaggttggaggatattttacatttacagcacatctgaattcagttgccatattttcatgggttaaagtaaacttgttctcccaaaccaatgaagttatggttaatggaagaatattaaaaactgtttgttttcaatataaataaaattgaagcaaaaataaagcaaaatgaaaatttggcttcctcagttatgctagtcccatttcaaatgttcagtagccacatataactagtggctatcttactggacaacataaccccagatcatgataaaacgttctgatttcccgaatttcttttttttagacaatctgggatgtttcgccttcttaccaaagaaacaaaaaggtgctggtactttttgtttgcttgtttttcagcagttgccattgaaatgtgtttcttttggagttggataggaaaaacctagattcttcctccaaggtgtagtctcaactgtgccccaggcatcactgtttatgatggattaagggtgtggcttttcccagataatgagtccccctcccccaccccccacaggccttaatatctacagctcctgtcaatagactggcctttccttccccgcgaaaagtttgagtcctttaagaatctaggtctaaggttaatttcaacgaaaggtttattttctctttctgcgaggacctatggaactacccagaacatataaagcagtccacaaggctcttcaacagcttcgtaaccgggcactgctagttcagaaactcactgacttctgaatgtccatttcacatttgcaggctgcttctctgagtcctgagctcttgtctcaagatgacttggctcttaattgttgtctgatttattaccggtttgctttgcagtttaggtgctggacaatgattcttagaaatccccacataaggatctacatgcagtggcagtgaatctcaataactgccttttcttgaatctgaacttaatttatatataaagcctactttccggtagatcctgcatatttcatctcagccaatttaggactgagatgccccccctttctctggggttttgtcttaaatttctggaggggacctgattgtcacgcccctccgagtgaagagaccaccaaacaggctttgtgtgagcaacaaggctgtttatttcacctgggtgcaggtgggctgagtctgaaaaaggagtcagccaagggtggtgggattatcattagttcttacaggttttgggataggcggtggagttaggagcgatgttttgcgagcagggggtggatctcacaaagtacattctcaagggtggggagaatgacaaagaaccttcttaagggtgggggagattacaaagtacattgatcagttagggtggggcagaaacaaatcacaatggtggaatgtcatcagttaaggctattttcactcttttgtggatcttcagttgcttcaggccatctggatgtataagggcaggtcacaggggatatgatggcttagctcagagtcctgacactgatacagtgccaggatttgaaggcgggtgtggcttacctgatttcatgtacaattcatcccatagggaccttgttccttggcctcaagttgtaggccctttcatatctctgtacggtcaagaaacatggtggttcccttgtcattcttcatcctccaaaaacccattgagcactgtgtttgctggaggcatgtgggaaattattctactgtaccctatatcctgctgaagtgcctgggtactgggtggctagctcatgtccatttgctaagacacatgctcacgattcttgcctgggtctgacataactttggagtcttgttgcattcctgggctggactctggaatgggacccaattacttctgcacctggatacccccaaccttctctgttgtggtggcggttctttcaccatcccctcctctcaggaacacactcttgtttctactttacattctccatccagtccaggaaaatagtatctaggctcagagacggagaaaatagtgtctatatttcacatttttttccaaaaaaaaaaattataattttccgtgcctggacttgagaatttgaaaactccaaaatcctccaggttcaaccacattgttcccaattacaggattttcttattaaagttgaatagtgttccattgtgtgtatattccacatttttgaatccgttcatctgttgatggttacttaggttgattccatatcttgtctaatgtgaatactgccacaataaacacgggtgtgcagatatctacttgatatactgatgtcatttccttaggtatgtacccagtagtgagattgctggattgtatggtagttctatttttatttttttttgaagaacttcctgctgttttccataatggctgtacctatttatgttcccattaagggtccaaggtttccctcttttccatattctcaccaacactagttatcctttgtctttttgagaatagccattctgacaggtgtggggtgatagcatattgttttaatttgcagttacctgactaatgataagcattttgtcatatacctgttgtccatttgtttcccttaagacatgctcgttgagacatggacacggggaggggaacatgacagaccggagcctgtgggggtgggggcgtagggagcaaggggagggagagcattaggacaaatacctaatgcacacaggacttaaaacctagatgacgggttgatagatgcagcaaaccaccatggcacatgtatacctatgtaagaagcctgcacgttctgcacatgtatcccagaacttaaaaaaaataaaaaataaaaattcagttccttaatcacagttgccactgtgattttactttgtcatattttaaaagcttttttatttcaaaaaaaaagtctgttgaggtcctttgcccatatttaattgggttgttgtattgctattgagtttaaggtttcttatatatttttggatattaatcagagtgaagggacaactcatggagcaggagaaaatatttgtataccatatacctgaaaagggattatttccttggctgtgcagaagctgtttaggttgatgcaacttcatttgtctatttttatttttgttgcctatgctcttgggttcatatccaaaaaatccttgcccagaccaatgtcataagcttttagttgatgtttttttttttttttttttttttttttttttgagacagtcttgctttgtcacccaggctggaatgcaatggtgcggtctaggctcacagcaacctccaccttccgggctccagtgattctcctgcctcagcctcctgagtagctgggactacaggcgctcaccacaacgaccggctaatttttgtatttttagtagagacggggtttcgccatgtttgccaggctggtctcaaacccctgacctcatgatctgcccgcctcaacctcccaaagtactgggattacaggcatgagccacctctcatagtccatgttttcttctagtagttttagtttcaggttttacctgtaagtctttaatccattttgagtcgattcttgtatataacagataagggtccaattttctttttatttatttattttttttgagatggattcttgctctgtcatccaggctggagtgcagtgatgggatctcggctcactgcaagctccgcctcccgggttcacaccattctcctgcctcagcctcccaagtagctgggactacaggctcctgtcagcacgcccggctaattttttgtatttttagtagagacggggtttcaccgtgttagccaggatggtctcgatctcctgacctcgtgatctgcccgcctcagcctcccaaagtgctgggattacaggtgtgagccaccatgcccagctgtaagggtccaattattaatattcccaattgaatggaagaagtaaaaggaaacaaaattaaccatattctcacttaaagtcattgttatcattttggcatatttcattgggttcctttttacccgaaatgagggttttctgctatttatttagatgtgatcgtgctatatttatgacttttcacccttttttactatcacataagtgattttaggttattatagacacactttaaatgttcacataatgaccacttattctaaagttaggcatttagttttttatttttgttgttctaaataacccagtagaccattttgtttccttttagacagcttccagcgcatgaaattattaggtcaaaggatattacctttttttttgagacggagtcttgctctgtcgcccaggctggagtgcagtggcgcgatctcggctcactgcaagcttcgcctcctgggttcacgccattctcctgcctcagcctcccgagtagctgggaccacaggcgcctgccaccacgcctggctaactttttgtatttttagtagagacggggtttcaccgtgttcgccaggatggtctcgatctcctgaccttgtaatcttcccacctcggcctcccaaagtgctgggattacaggcttgagccaccgtgcccagccaggatattaacattttttaaagggtctttatatgtatcgcaaaaatacttagcaaaattattattattattattttttaccagtttacactgcccaccaagaagctataaggacacctaaattgtcacataaaactgtgtatggataaatatctctattttataaaccacttggtataaccaaaatcctgcttttgagatattaaattttgaagctaacattcttagcatgtttttaaaataatactgacttcatgagctaatacccataatgataaaatgattttatattccaggaaagctgccatgtgggattgaatgttttatatatgatacacttttatctacatatgttgttatacagtcattggtacctttttattagatgaatttatttcatattcagtttccactgaattgtattcagcttgactacaaattagtcaagcagaataagaatgtgagttttattgtgactaatatatatttggagtctagatttggagagacaaggggtgagtaaaactgtgtgcctactacctgaaaggaaaggttttttttttttttttttttttccccctcaagggaaacaattacggagactgcccaggcatttaatattttattgaaatattctaaaccctcaaatttcgcttctacattttatgtgatgcatcagaaaaacactattttatttgttttataattctccaatagggaaatttcaacacattgtaagtttctttatttaacaacatcatctagcttttaataactgactttcatacacatttttaaaagcaggctaatcgttatagcttaatatatttttcatgagatttagtgataacatgatcacttataccagtagtttatctcctgaatcattttaaaaagtaatgtgcatgttttctttatatttatatacaattgggaagcttaatatttatgaaaatatgattgacttttttttgtcatttctcttcaaagccttaggctttgcagttatcagtagtgcagttccaagatgcaaagtcataaacttacctttcattctctttagtaggcttaatattttgaatctagccataggaagcagcctgaaacctctaatcgaaatcaaagataacaccacaggggtacaatatctctaatttgtcttggaatgatgcggtagcttcccttgactgctgtgattaaattcattctggtttgttcagttaatgagattagcacatcttaacccataggaaatattgtctttatgggcctatgactctgaacagattagcatcatgatcagaaaaataatttttaataaatgattacgtgtgagtggtgctaggctaggatccctacaaatctggcaagagcatattccttgaccttcagcattatatgactttataagacacagcattttctcaggcatgggtataaatacagttaaatatgtactataaaactaaagaacagcctgaaatttaagaactacaagaatttgtgcttgtcattaagctggagataaagttaacatcctgagaagatgtaaaggcgacagtgatacacttctccttgtttggtaggatcatttccacacttgtctgtacttggaattgtaaggtgatgagtcccttaatgatttcttattgcaagtttgaacctagtgtatttcatggtaatagactaaggggaatgagtatatgaaatgagttccagtgtattgatgaaacttagagttgcgtagagtggagcatagcttagtagaaacttgagcaagttactgtagcacatggtcctggttccaattccagcaacatctgttagttttaggacttggtgcaacttgttcaaattttctgtcagactctccattggtttaaaaaataaaattcaaaatattgacaaatattgccttcctgaattttttggtgaatattaagttagatgatgtatataaagtgcctggcccatagtaagggctcaataaaagtagctgttggtaccgcttttaactaattgttgttaaattgattggttaattatatatttccctgccacttaactgtcactcaacagcttttcctcatttcctgcctacctgattggaaatcattatgttgaatatgtctagaattatcactgggcctgctgtattccctgggtggtatgtttgtataggttgaaccactaaagaaaatcttttcggatgagttactttcctatgtcaccctactatttcctagtgggaactttaagttccttcagtctggggtcaagactagtcttagtataggggacattgggaatattgaggatggcatgtttaagtaacattgtatgtattggtcaagaaaaaacaggcaagggatagagtacatcaaaaccagaaaacctatgtacttacctttccatttctgtctttattagatatgttgagtttatttcaagtgcctctatagaacatctacagaacattaatattaagaatatcatgaaaagggatacatttttaagagcctaaattttggataaaatggaagtcattttcttttttttttttttttttttttttttttgaaacagagtcttgctctgtcacccaggctggagtgcagtggcatgatctcggctcactgcaacctctgcctcccgggttcacgccattctcctgcctcagcctcccaagtagctgggactacaggtgcccgccaccatgcccggctaattttttgtatttttagtagagacggggtttcaccgtgttagccagggtggtctcgaactcctgacctcgtgatccacctggctcggcctcccaaagtgcggggattacaggcgtgagccaccgcgcctggccatggaagccattttctaacaacaaatttaatttgtgaaaagctggtagcatgttaactctagaatgacaattttttaaaaggaaaattccaaagttaaagggaaaaaatattggggtagtgccagctagtatcaggatttatactttaaaaatgcataagaaagaagcaattaccagtgtccaaataagaaatgagagtaatagaaaactcagatttcattgtattataaatttaataaataagttacacaattgccgttcagtgcctgaaattgatttttctttttttgaggtcaaacttcaaccatgtatatgaaatgtaagagcaactttctaagcagaattaccctttctgatttccttgggttccttttggttctttaatctgtatgactaagagtgtggattggctgacattatgagatgcaattaatttacatgcttaagttaggactataccatcctgtttccatccattcttgatcacaagcatattacaaatgctgtgctggattatctttactattaagacatactgcagaaagccctgcaggtaaagaaaacaatctagggcttaccttagaggcaggaagaattgcatgttaagaaagctgcatacactctggctttttgctctttgagtttagctcaatgtcttcctaaactttggtgtgcaggaggtgactacgcagtatttaaaatctaatccatattatgtgtatagtatggatggtatagcaattttccaggtggatttttgacaatattttattttttactattcatgttgactttgaaaaataactacagggctagatttgattcaactgtccatggttagaatttttaaaaaagtttttgactctaatacaactgagttccatctacagaaagaatgcacatatggatacggctgtccagaagatcaaatatccttgtactgaagtatatctatatttagtcattattttataaaagtagtagaaaacaatagtggaatataatatgtggtctttggaagaatgagaaatcatccttacccattaaacacagacccaacacttaatgtatttccattttgatagtgacaagttttgggtttgggatgatgtgtcagccagggtcagttaacagacagaaaccacttgagtgactgtagcagaaaataatgtaacaagaggaattgggatctaggtattgaaaaattgacaaagagaagaggtagcaagtgcacaaagtagctaccgctcctagggctgggaagacaaaaggttagaattactaacacttagaacccttgaggaaggactctacaaagctgagctcaggtctgagtagggggctgctacgtggctggtgctaccctctctgggatagcaggaagggcccaatgggactgaggcccggacctctgccagccaggtggtgctggtatttctgcagcaggggcgatgaagctgattctctaagcttttgaaaaacaaaacacaagctaaattgaatagcttgttactaaaaagtgctgctgcaggcatgaagaagcacgtctagggaactgctaataaggacagtaagtgcatgggaagctagtgtgaatgagtaaatcctttgtccctcctccaggcttgcagtctccctctattgctccctacctttagattctgagagtcagtcagtaaagccagaagtacggtttgcagagtctttgcctcagcgttgcaaagtagggtttagaagggtgtgttggtatggctctgaggaagataaaatctctaaccagcatgagtgctaatatgtctaataagatatatggaaaataattattaagtatttgactgaatttcaaggattaaaaagcaatacttaaggcaacaaaaacatcttatatttccattaaagcataatttttcttacagctccttcacattggcaaaattagtttgccctcttgaatttttcaaagatgtgaattatggcaagtaataattgctgcctactattgaatatctggatgttgtagaactgccattgtatcatatttaacttatttttgagagtgttagatttcctctgatagaagatattttttacttttccaagattaatagtagaaatattgaacatcaaatcattttacagataatactgtcctaacattgcgtaagtatacaattattcatagactcagaaatcataattgtcttcacagaaagaaaccagttcagaatactttaagaactatttggaatgttagatttaaaatattctgtagccaaggtaaagcaagttagctaaaattccttttgtttctattgtttttagaactagcttcaaagagaaagaatttgataaatacttagtgtccaataggctctttcatacagttcaaagatgtagactgacactggcatctacagttcctagctgtacttactctggtattttttgccagctgccttcgtggtttctgcttcatacctgtttgtattcataaataactcaatctaagatttttagctttttaaaaagaattgcatacaatcatcatcagattacaggtttgaaagaaatcttagtttttttctttttcttttttttgagatggagttttgctgtcgttgcccaggctggagtgcgatggcgcaatatcggctcaccgcaacctccgccttctgggttcaagcgattctcctgcctcagcctcctgagtagctgggattacaggcatgcgtcaccacacctggctaattttgtatttgtagtagagatgaggtttctccatgttggtcaggctggtctcgaactcccgacctcaggtggtcttcccacctcggccgtctaaagtgctgggattacaggcgtgagccactgcgcctagcccagaaatcttagtctttttaactcagttttgagattctgccatatacctggcactgtagttaagagatggcatataaatgggaaaaataggtatttcaaaagcaatcaaaagcaattacaagactatatagtatgtcctaccacgggggtatgcatgggagcagaaggaagaagagacgaattttgcttggctagggttgtattggggttgaaattgatatcaactatagactagaaacttaaagggattttcatgccaacaagagtacaacaggccattcaagtccatctcttccaaacattgattaaacatcttttataggcagacaatcagttagttgctaagaagactaagctgaaaaaggcttttttttttttggccctgttggagctttcagcctattggctgattaaaaaaaaaaaaaaatgctgaggagtatgaagtcacaaaccaattgagttcaggaaccagtaagtagtttgacatgaccgtaatggaggttttgggatatgggcaattggcaaaaaattgaaaaggatgcgggaaaggtggactggggatacaatgtggatggatgattccttgctcaattgagatgaatgtgttcaaaaaaaccaggaagtttttttttatgttttgcatattagaaagttacatttggtggctatatgcagaatcgtgtatggggagagtacaggtgtggaggtcactcatgaggctaatgtctattcaaatgggagaagaggaaggtctgaaaggcaatcactattggaatacatgcaagtacatctagcattgttctgtctttctgaagatgtggaaatgaagctctctcagaattaaatgacaacatgccatggctgtttgttagagggaatggaagtagagattgaaggtcttgatttccagctgatcatcctttttatggtaccataccactcacccagcctgttgaactggaaaagattatgaacatcaggcattaacctaccaaagtaaagcaaaacaaaaacgctgaacttctccatatttttaaaaatatgtgacacatatatgtttattggaaattaaaatacagtaaaggctctttaactgtcattcaataaatattttttgaatgaacgacgatcacttgtcaataactggtattaaaaaagacaaatattaatggtgatctttattcaataatttcataaaatgggaacaaagtggtaatttgccagtaggatgaggagggcatagcagaggttgtctaaccttttggcaagggcaaagtcaaactggtgaataagcaacacaagctgtgatgagagtcatgtgccatatgtaaatggtgactctttcttcctccaatgctgtttatcaccacaggcttcccagcggcccaagaacagtctgccgcagtcactggcattaataaatgccatctctacctgaatgcccttcttttcaaatttttaccaaaaggaagatagtagactttcagttttccttctggctgtgagaggcatagggagaataacggtaacagatgcaggaataaaaaggcttgatacacatggatattatgtcatgagggattcaggagtttatattaatatacaaatattagttgttttttttttgtttgttttttgttttttgttttttttttgagacgtagtcttggtctgtcgcctaggctagagtgcagtggtgctgtctcaactcaatgcaacctccgcctcccgggttcaagcaactctcctgcctcagcctccccagtagctgggattacaggtacctgccactgtgcccggctaatttttgtgtttttaatagagatggggtttctccatctcggtcaggctggtctcgaactcctgacctcgtgatccacctgcctcagcctcccaaagtgttgggcttacaggcatgagccattgcacctggccccaatattacgatttatcctgccctacctcaccactcttttcatgattagagatggaaaaatttgatattatttaaaaatcagtaagattctatctaatcaaaccattggcagtataattcacaacttttttagagattttctaaagtaatacagatactgtagtattgtagttttgtagtatagctacaagaaaatcatactgtgctctgaaatgctatcttagtaacatattgtgttaatggattataatggtaatcaaaacctccatagagctacaggtttgaactctaacattctgtcgaagttaaagattaatcagtttaacaccatattatttttattatttttgagacgtagtctcactctgtcgcccaggctggggtgcagtggagcaatctcggctcactgcaagctccgcctcccaggttcatgccattctcctgccttagcctcccgagtagctgggactacaggcgcccgccactacacccggctaatttttgtctttttattagagagagatggggtttcaccgtgttagccaggatggtcttgatctcctgacctcgtgatccgccctcctcggcctcccaaagtgctgggattacaggcgtgagccaccgcgcccggcccattcctagtattttcaaatagaaatctgatgcctttattactgtaattagaggaatgcttatgtttcaggttgggttttggtaaagcccatgtggagaggagaatttgcatgaaagtagtttaattaaggaaatgttctcagggatggcaagtaggtgagcaagagaagtagaataggaatggggaagaaatcatgcaaggagcaatcgcaggcaaagtgccagcctcagtctggttctgcaggaaaacctgggcctaaactatgcttcagcttgttgcaacttgatacagaaggagctgggcttttgtattccagtagtcaccagtcattgccttaagactaccctaaggtgacataaacaccaaggcacttccggatctctgtttttgttggcaaagcagctttactagcctgaagacagtcatctaaagagatgtagatacagaagttttgagaagcaaagaccacaaaagccaaggaggtgggcacgcagaagtgttaatggaatcttagtggatctggataaaacacgattttttggctataacctctaaagggctaactttcagaagattacgtggacccaattaagcacttacctgaataattttgaaacatctctaattgtactatagctagagttaaaagaaaaaatattttctaatataaacaaaaagttcagaattatagcattattaaagaagcttttttcaaatgttagcattcctgcttcttgactttacatttttccggaacaaaatagttttccaaagagtatacttaatgacttgtgcagatgaattctaaatgataaccacagggctcttggacaagggatcatttaaattttgagttcttgtcagtcagacatatcaatccatatacatttccccaaccagggtgtcagaagtgtagtcaagtgagttttgtaatgatacttctttgtttacatctagctgcagaaacctcttaagactgattctgcatcagaataattgctagagggaaaagggaagctgtgattatgaaataacactgttatccactggcacccctttgtgtctatcttagttgaagctttgaggcacttctgtgtctattatttgattttaattggcaatggtattgattataaatcatttgacagaatataatttttatcttaaagtttaaatgtacctagaggctacaaagattcctgcgttcaatgaaaacattaaagtaatagtgtaagtagtttaaatgtgccccatttggcacagattagtgtcacctatggtacaactcagtcaaaaagtgaatgtagctgaaaactgaaactgttcaacagctccaaatttaagaaacacggaacattcactatgtgcaatagacaatgctagttttagtaggggattaaaaaaaaatatctttcagccaggggctcataaagtagtgaggaaacctacaacaacttcaagtcagataatgacaatatgtcattaagggacatgaacaaatgaccgagagaccgcaagatcaggagggactttttttggagttggttataaaggaatggcaaggcacatgggaatcaagaattcattcaaacagagccttgaagaaaggtgttggtggagtggaaggctagaacacaaaaatacaatctacagaataagaaagcactagggggcaactgtggttggagtacttacaagaacggtttaggaaaataactagttgtactacatagactaaattggataactgtcaagatttgaggattataggtgaagaaaccattttagagtttattataactgacattttgtatctagagacaacagggatatcagtattgatgtaattaaaggatgtggcaagaatgaggtgaaaataacttatgtcttagggctgaaaaattgagaggatggtggtatcattggatatggttagaaatagaaataagcaaaactatgatggggaagtgatttgtatttgggatatattgtctttgatgtattgatgggatatccaataatctccggaaaatatgtctggatctgaggagggaaatcagtgtgtgtttgataggtgtagcagtgagaaagtatcataggcaagataccacaactaaagaaaatggtttgggggtaatcaatatggagtttaagccatgggggcagatgatacggcaaaaggatattatacacagttaaaaaggaacccaaaaccaagtcttggagaattcacatttaaatacgtgcagatatagagaagccagcaaagaagtgttaggagaagtcacaggaaactgtaaagtgtctggtcacagaagcagcaagaaaaacagtttttaaggaggtgactacattgaccaaaggcagtgattgaattgaaatttacttggggtctgagaaaagaccattcggttttctggttgctttgactaattttaaagtaacaatttcagtggagtagtagaccataacctataaatgcattgatgtatttatttattcattcactcactaattcacttatccaatagtcattcatttattcttcggtgcttacaaccgggcctggcactggattaaagtgaaattagaagtagataaactggtagagatagccaaaacatatctccctacagaagggaaaagagcagaaaattatcatggaaacactttgcatagagtttctcacagcaggttgaaagtatcctaaggttatagcagtgtaggctggaggaaaaggagaaaatacagactaggcaggacaggcactggggaaattcaggtgtaactaagaagagactgagtgctgggagacagggtgtaatctgttaaatagaaacataggcaatagtaaatcagggaaccagaaagagttcaagagtcgatgaagagggacatgtatcaaggtctcgatcgagagggctgtgattcaaggcagagcctccattccagagggagcttaggatactcttctggttttctattactatgtaacaaaacaccccaagtacagtggcttaaaataacatctcttttatctttttatctgattttgtgaatcaggaattcagccgtgttcagcttattgatttttctactctgtgtggtgtcagttgacatcacttggcagaattcagctagtggatgtgctggtctggagggttcaagacagattcacttaatgcttaatgccattgtgagaatggctgaaaggctcagttcagcagggactgtcaaccagaggacttgtagatgtcttctacagcatggtggtttcagggtagtcagtttttatgcatggcatcttagggctcccagagtgagtattctaagaaacccataaagaggctaaaagttactaataatgatctaatcttggaagacctataacatcatattcgttgcattctacttggcagacaagttgctaagacaaatccgagctttaaggggagaattagatgctgcctcttgatgaaagaagtgtcaaataattttgtggccatttctagtccatcataactgctgtaaatttcctcctcctaccatggtattgagtgatgcatatctcacaggaggagagtgtgtcagtgactctagctgagaagggcagaagaaagaagatccttgcacaaacaagccaggcgagagagaaaactggcagtttttaggaaagaaaagagatgcatcttggcaggaaacaattgatggtagccagagttcaaggctcatgctgaccgttcattcttctacattttctaagctcaatctttgtatcaatagagaatatcagaaaacttccttggggaatcttactttggctctctgtaaaaatgaacttgtcgcaatgttctaccctcaacaatgggtgaacacagatttaagaaaaagacatgaaaagcttatctgttcttttgtgaaagtgccaaacactttctgttaaggttttcattgttgttaaagtgaaaatttggtatgacagctgctgtgagggatagacttaaggccttgcaactcaaattatggtctgcaatctaggagcaccagttgaggttttgttagaaatgtacattttcaggcgctatcctagacctcacacgagtctgcacttgactaacatcttcagaggtttcatgtgcaaacaaatgttgagaaactctgatctaagggatgtttcattattcagatcattgcaaaggacttgttaggttcctgttcttggtcttgtccctgtggacttcagattgaaaatcttacccttagcttaggctaagataaaattcctttccttttatttgatggcaattatacataacatgtcattacttgatttttattcgactttggagaagcaaagggttttggctaatttttagtaactattcttagcttttacaatgttatcattttatgtttgcattttttcctagccttatttagattctagacacagaataggggactgtgagtgctgagagtatccttagagaataaccactgtaacctacttcattttcatataagaaatgaatgctcagaaatgtgccttgatgtactcatggctacttaatcagtggtaaagctgagcctagaattatttcctcaaaattgtagtcctctgtacacttggatcagaattaacaggcaatgcatgtcataacgggctcatccaggtggttctaatatatactaaagtctgagaaacaggcctgagtgtagcttcaatgtctgctctctcactctaatgcctactgcctgccatatctagatgcctgtgtgtatgtgaacgaggagggaagagaattaaatcctagagatgttggtagccaattatctcaaaagcacatatttaggggtcagcttttaaaaggaggaggggggcttattcccctgacatttgagcaaagcaggaaagggtcggtgatgaaatgccatgtgtcctgaggacctacaggcctgggttatatgaccacttcaggaattgcatagcaatcaaaaagggaactaaaagaatcggaggctgggtaaaatcaggactaacaattgataaagcaattatgatcaacagtgagtgagagaaggagatttacctgatggtgaggtggtagccaccactaagattagtttaaataagattagccaccactaagagttttaaaatgaatgcatgaggcactggagtcttccattgcttctcttgccctccttgatgtcttctgacaggagccatagagatctttataaaacacaaactagatcatatctctcctacccaaagcctgtaaaagcatctctattacatttagtttaacatctctactgtggcttaccccttatccttctttgcccactaacttcatttagcatccacttcccctacttccctttgtgcatcttgtgcctgctatctgtaattcttccctttttataaaatctcctttttaagatcataccttgaattgtatctcttcagaaagggcttcctatagcttagccttaaaattctttttcagttgactttatttctaccttagcatgtaaaatgttgtcatctcttatttgttgttcatcttcttgagacagtaagctccagaaatgcagaaactaaatcattattcaatctaacctcatgtgatatctgtcacattgtagataatacttgaattttaaaaaggggacagaagtttcaagaacagtatactgtggtttaagtgagcaattcactgtgtgtgatccatggggtaggatggttcgaggtaggtgagaaagcatgaactggccatgaacatggacgcaaattgatcaaagtcattgcagcttagcaggtcaaaaagctgtgaggtcagagcatcagttaaaatgttcaatggtagttggtcatgatggcattagcaacctttaaatttaaagggacttaagtcacatccagaaatcggggatgacaagcctatagtcatcctctcttgaagtcttctgctgatacaagtaatcattcagtctgttggtctctatccccatgtcaccaccaacgatgactgggatccagtcaagcccttggatatcatgtcctctctcgtgtccttttcataccaatttaatcatgcctggagtgcccagaagcatactttcagtctcgcctgctttgacacctgactcattcatgccttaacctactgtgctagtgttatgatggggagggagggggtgactgagtggatttgacctcccaaaccatattctagcaagcaaggtacatcttaactctggaattcttctaaacctatatagggtttctgaaacttagtctcagagtgggagtggaatgatacagtactttgtcagaagctcataacaacgactgtgtcttaccataatccattacaatactgttcttgttccagttgaacagctggaagttgaaaaacatttcctttggaatgagtcaaactgtatcttacacaatcttcccagctcttatttacgagatagataatgtcattggtgctcaatatactaaggatttttcaatgcagggctctaatcttatcaatagattccagggaattactgagaaacacattatttgatccttgatgtctctttccttgtatttttatagtagcacgcttgaggaagtacacatatatagcttccaagaatgagggaaggcatcagttaatatgttaaaatagaaacctcccacttgatcttaagtatggggagggcgggggaaggagacaagccttaagcctgtttaccattgcaggtaaacaaacatgaagatcaaattctaagtaaggagagtttgttatggaatagctgagactgagggcataaagacaaccattcaaattattctagggtttcagaagacactgaagaaagaatagggagatgaactgttggtgaagcagagaggaaaaatagaccaagattaagagaaaaaaaacacgggaaaagattgcaggttggaggagggtgggtctatccaaggctgaggtcgaagcttacggcaaggatgcaggggaagaatgttttgttaatggtaaatagattgcaaaaattctgtagtttgcctgttcattctgatgatgggttttgtggttttttttttttttttttttttttttttttgctgtacagaagccttttagttctatctcagttgttaatttttagttttgttgcaattgactgatgtttttgtcaggaaatcaaaatctttgcctgtgcatatatcctgaatggtattgcttagattttcttacagggtttttatagttagtgggttttgtgtttaagtctttaatccatcttgagttaatttttgtataaggtgtaaggaaggtgtccagtttcagttttctgaatatggctagccagtcttcccagcaccatttattaaatagggaatcctttccccattgcttgtttttgtcaggtttgtcaaacatcagttggttgggtattagatgtgtgatcttatttccaagatgttggttctgttccattggtctatgtgtctgtttttctaccagtaccatgatgttttgggtagtatagtctgaagtcaggtagcattaggcttctagctttgttatttttgcttaggattgtcttggctatatgggctcctttttggttctgtatgaattttaaaacagttttctttttttctaattctgtgaataatgtcaatggtagataaatgggaatagcattgaatctataaattatacagtatggccattttcacagtattgattctatccatgagcatggaatgttcttccatttgtttgtgtcctcttagttccttgagcagtggtttgtagctctccttgaagaggtggtgcacttagcctgttagctgtattcctacttactttattctctttgtagccattgtaaatgggagttcatacatgatttggctctctgtctattgttgtaggaatgcttgtgatttttacacattgatttttgtatcctgagactttgctgaatttgcttgccagcttaaggagattttggggtgagacgatggagttttctagatacacagaagagacagtttgacttcctctcttcctatttatccttgatttctttctcttgcctgattgccctggccagaaattccaatacagtgttgaataggaatggtaagagagggcatccttgtcttgtgctggttttcaagggtttgtcataccaaaacctacagccagtttttgcccatctagtatgatattggctgtaggtttgtcataaatagctcttatttagagacatgttccatcaatacctaatctactgaaggtttttaacatgaaaggatgttgaattttatcaagacttttctgcgtctattcattcctttgcattcttttttctctaatcttgtctgctggtgttatttcagcaagataatcttcaagctctgaaattcattcttctgcttggtctatttggttattgatacttgcggtagcattgtgaagttcttgtgttttttcagctcccttgggtcatttatgttactctctagactgataattcttgttaacagctcctgtaatgttttatcatggctcttaacttctttgcattgggttagaccatgctcctttagctcagtaaagttcgttattactcatcttctgaagcctacttctgtcaattcagccgtctcagcctctgtccacttctgtgcccttgctggagaggagttgcaatcacttgcaggagaagaggcactctggctttttgagttttcagtgtttttgttttttgattctcatcttcatgagtttgtctagtttcaatcttggaggctgctgacctttggatggggttttaattgggattttttttgttgatgctgttgttgttgctttctgtttgcttttttaacaggtccctcttctatagggctgctgcagtttgttgggggttcgctccagaccccattcacctgggtcccttctgcacttggaaatgtcacctaaggaggctgcagaacagcaaagatggctgcctgctccttcctctagtatctctgtccctgagggtcactgaccagatgccagcaggaaccttcctgtataaggtgtctagcgactgctgttgggggtgggtctcacccagtcagggtgcacgggatccaggacccacttaaggaagcactctggctgccccttggtcgagggggtttgctgtcctgggggaatcccacttgtctgggcttcccggattctttagagccagcagggtaaagactaagtccgctgatctgcggagaccatggccacccctccccctaggggctcaggtccaggggaatcggagttctttccctaaacccctggctggagttactggaattcctgcaagcaggccctgcccagtgaggagggatgggtcagagtccggcctaatgaggcaatctggccattatttgccatagctggtgtgctgtactgcagggaattcctcctgggttcaaactgtccagtctccctcaaacctgaaggggaaaaatggtggactggagctgcagtgatggctgctgccctccctacaggagctcagtcctctcagtaagccggtagccaccgtgatggctgctgcccctccccacagcagctcagttctcttaggtggcagttctcttagatgccgcccctccccgggagagctcagtcatttgctgtaacaggcagctgcagtgatgatggccgcccccgcccccggaaactgagcagtcttaaggagtcgtctccatccgagtggcctgcgagaatctgcacagctgtgttttgagacccaaggccctgttggcatgggctcgcaagtgggatctcctgatctgcgggttgcacagatctgtggaaaaagaaagatttcccaggcagggtaggacaatcactcactacctcccttggctgggagtgggagcttcccttgtcgcgtttggctcccaggtgggccatggcaccaccctgcttttccttgcgctctcatgccaactgcctagtcagtcccagtgagagaacctggacacctctgttgctggtgcaggattcactcacggttttggttcttctcagtgggagcctctgactgcagctgttcctagttggtcatcttggcctctctccatatttttccatttttgatgtaactttaagtttttgcttaaattcccatattggatattacagtctaaaatcaagagaaggttaatgtggaccgagccattatttaaatttaaggttcaaagaggtaggtcattcagccaggtgagtgagcaccaatcttttaaaaagttggttaactatttgatagtttccacttttcaagctgataatgatattttaaaccaaggtcatttcaatttccttttggttcaatatttttggaaagttgctacctctttgaaataaaaatattttgtacaggattgtttacaattagcaaatgtttgctgataaagatgaatcactgaattaggtaccttttgtagttatgtaataaagctcttggtaaaaacttctatttaagcagttataactaatttttcctattgaaatgtcaggtacctattaagattttctcatagggcaattttaaattttttctttgagctttgtaagaaaaaaattgtcaactctactttcctttggctcttattcaactttattttaaaatgcatttttctagaaacactaactaaaggtgacagttttagttcacagggaactatttttgatttactatttttgttttggaaatgtctgaataaaccactggaaattatagcttataatgaagaaaacaagataaacacactttttatctaaagtgacagtaaaaatctagcaaatgggagaaaaataaagtcaacttttttttttttttaacttctccaattgaacgtcaaatgaacatattgggcaaggaatacaaccttagttgcatttacaatacagtggctacaacagaagagttaaacactaagtcttacgaaaggtagctttagaaatatttgaaagttggccgggtacggtggttcaggcctataatcccagcactttgggaggccgaggtgggcggatcacgaggtcaggagtttgagactggcctggccaatgtggtgaaaccctgtttctactaaaaaaatacaaaaatcagctgggcgtggtggcatgcgcctgtaatcccagctacttggaaggctgaggcaggagaatcgcttgacactgggagacggaggttgcagtgagctgagaccacaccactgcgctgcaggctgggcgaaagagtgaaactctgtccccccccccccacccccccacccccccccaaaaaaaagtgtgtgtatgtatatattaaggttgacactgtatttaaaaaatttctatgaaactgacaaaactattgcttcgttaattcttttttgcaagattgcattggaggaactgcatggaatataatgactgtgttcttttctaatagcacatgagtcagatctctagaaactgacttttgcccatattcaatttcagcagtaaaataatttctagcttgatatttctcataaaaactcctagggctcttttaaaaatattttataaatatctttataatgtggcttaatttttcagacatcttctgtgtagaaacaaatattcatatgtatgtacacatattagctattgctgtgtaataagccaccttgaaactcagtaggttaaaacaaccaacatactatttcaaatacatatgttagccaggaagttcttcaccttactgctaggattactcgtgtgtctctagttagctgggggttggctaaggggctttgctgatctcagctcagctctgcgaaatgtctggctgtctgctagtctgggaaaacttcatctgggacaactagggcaacttgactcggttccacttgtctcatcctcctgctgtctagctctgatgtgctcttacggtaaatgcagaggcatgaacaagagagcaaaagtgttcaagcccttttgaggtctacatttgggagaggaaatgccagcacttcaattgcactctgttggtcaaaatgagtcaaatgccaacccagatttaagaagcagggaaatagataccaacttttcatgagaagaacagcaatgctacattgcaaagggtatggattcaggaaaggatgaaatactaggcccaattttgtagttaacttaccatttacagcagttgctcctggacagtatggcttccttgccaaatatttttgcatgcaaataattggtaaacagtgccaatattggtttttcctaaacaatactatgttaaagtgtcagtcaaaatatgaattaaaaaatgcaaaacatggtaagagcttctcaaaattagttatgtttgaaagggtgaaaagaaaagacaagcagacatttgcctaagcagctttgggtggttaatcaagtcggtacactcggatggggtgtcttgtacctctctagtctcatgttccatccgtccacttacgttccaagaagtggcttatagttccttgaacagtgcgtctatttcatctgatccttagcatgtgaagtttcctctgcttgactttatcttccctttacacttctacctgttgataacctgttcaaccttgtatattctattcagggattttcactctgttgttctctccagtgaagatatcttttatttgtgccagcaccatacttacgacaaaaaaatcactattaataggattataacaccatgctataattatattcgcttaaatgtatatttccttcctaggctattacaaaagctgtgaaaacagtggcagtatgtttttatcttttatcttcccatttttcttaggacagtatgatgcataatactggttacatttagttgaatgactatccccctcgtctgacacataaggaaaataagccaagtgctatgtaatttatcagtgttcacacaactggcaaaatttaaattatagaactgtaataaataaaggcctatttgcttccagatactatattatttaacttacaactacaccgaatctcacatggaagactttcaagtaaggaactggcacttttcagtggatcttaagaaatggctacactaaatgccctagttaaactttttcttctgtttactactacctcatttaatccttatcaacttcaaggattatatttcttatattttgatttatatagccttaagtttttgttgaatgatatttcttctttagttaatataaaaagccacatttttcaaatacattagagtgaattatacattcgaacaatttgcagtgtgctctaaaatagtatttagtaattgagtctgctgagcacactggagtcctgaggagttaatgaaacccccgatgtcaaatgatataacaataggaatttgggactttgaagaattttcctaatgtatatatgtagaattatcactgttactatctttccattacaaatgggacctacaattaggagcaattttattggcaggctatataactgtatctgaccttttggaaatgatagaagaaagaaaagatatattaaactatctttgtagaaaagatgacgtaaaggctcaagtaaaactcacctaacccttgcccctgaatgtgatgatagtcaagcccagcttaaacagcagttgcaaagtaaagaatggtgtagagatctgtagatacactgcctaagtccaaattagtatctagcacttacttgctgtgtgaccttattcaagttacttatattgtgtctgtttcatcagttgtaaaatgggggtgactgtgaacattaaaacaacccacaaaaagtacacagaagtagcgctgacataaaccagtcgatgtgtgtaactcgcatctttctgatacatgaggtagagtcatataaaaattgtaatatttgacaatatttgacttcagaattggaaattgcataaagttggaccactaaaaggaaataaagcatagcagtgacagacgttctcctttaaatattttatcctctgtgacttttgacagaagatcttctttaaatattgtatcctatgtgacatttatcttttctgtgtttccaatttctttgatttggaacttcctgtagacagacccttacaggcatggaagaagaaagaatgaataaaccaaggatgacttcccagtaggtggaggatgggaataattaggaagaagctgtgtcttgtcacctatattgtccatacacaactgcaccgtagggtaattgagaaattataagaatggtaataaatacgttttacattcattaattaaagtcatctttggatgccctttgtccataatgtttcctctactagatctgaagcctaaatatcacttttcttctctgcaatttccctggaactgagtactcatagatgtttgtctagtgagccattccattatgtcatggtatatgtgtgtatttgtgtgtgtgtgtgtgtgtgtgtgtgtgtgtgtgtgtataaacacaatcttttttttttttttttgagacggagtctcactctgccacccaggctggagtgcagtggtgcaatcttggctcactgcaacctctgcctcccagattctctcccaccttagcctcccaagtagctgggacttcaggcgcgtgccaccatgcccagctaacttttgtatttttagtaaaggtggagtttcgccacgttggccaggctggtctcaaactcctggcttcaagtgatctgcccttctcggcctcccaaagtactggggttacaggcatgagccactgcgcctagcctatagatttcttttttgaagaatcagtgttatttgcatgctttgaaacaaagtgcttcatcttgccaaccttgtaccataccgtttctgtcagaaaagcaaccattgggatagattgtaattagccttcatttccatcactggctatctcaaatgcaaatcatgtatctatgtgaatcaaaagaaaaactggatttaggcctggtgcagtggctcatgcctgtaaatctcagcactttgggaggctgaggcaggtggatcacgaggtcaggaggtcgagaccagcctggctaacaaggtgaaaccccgtctctactaaaaatataaaaaaattagccaagcgtagtggctcgcgcctgtaatcccagctactagggacgcggaggcaggagaatcgcttgaacctgggaggcggaggttgcagtgagccaagatcacgccactacactccagccaaggtgacagagtctcaacaacaacaaaaaactgggtttaactttcagaatgttcaattttataggggatatttaaaggtggtgtaattagtataatcatggattgtaatcattccacaaattttaaaataactttgtgaattacattaatacataaaaatataagataaagcatttaccataattttattaatatttcctttagaatacctggtaaaatgaatgagtactgacctaacttaaagataaaacaattgagacctagctttagaagttagttttattacaaaacatgttaaggatagacctgatcagacaatgaatcatgctgactttttgttaagcatacttctgggttcataacatcccacttacatataacaacttgatttccattaacgatggtgtggtttcctatttaaagttcgaatgcacatctgtttgaatcatttctagtgtacttaatagagtaacatacatattgggttctagttaagatgctttataaaatgccaaataacattttatatctggagagattataaaaacttgtattttgtagctttgctcttgaacacttgctagctgcaaggaataacttggctttttcttgatgatcttcatagccagattttcgtgctttttttggtagagagaagtctctacaagtatttgacgctaaggaataatgaataaatacctactgattttatctgctaaggtccacaaaacattccagtattttgatatcactattaaagaagacgacggtgttccagtgatacatatgattccttacaatgacatcaccagagatagaaatatgaggcatgggaagtaacacgtaggccttcatttattttctgatatggacatccctggcattgatctccttggctcaaaggaaatttgcttccatgtctagggtggtgaatgtctttggcttatttctttggccctactctccacttttgtcttccttgggaggctgatgtctgtggactacatcaacaggctcctttgccctctggctactagttggatttggccaatgagagccttggtaagagagggagagaggaaagaaattccatcacccaatatcaaagctcctgtcagataatcttctcttctcagttctctctctatgtagtaactagaaaccactctccttcttttcattcttaggagtctaagagtagtagtgacacttctctattactagttccagtggtttcattataccttccctcatttttataaacagtcccttattaaactcttctcagattaccaaagtcctgctatggccatataaatttcaaaggagagtgtcattctccacctccaggtgataacatttaacaggagggaatgtaatttatttaatgtttttattgagcattttctatgctaggtaccataccagacatcttacatttattaacccttttaattctcatattttgaagttggtcccttctgttactttgaggccaacattacaaggaaagttatagacgatatggattatttggcttagaaagtttggaataaacgtgtgatagctaacacttacagaatatatcttacaaagtgccatactaagttcacttaaatctttgcaatatcaccacaacataggtaatgatacatgctctttctatagatgaaaagagtaaggcacggagaagttacttgcccaagatcacactgcagagctgggagttgaacccaaggcattctgggtgtacagtcaacattcttattcatggcatcataccattcccccgtgttttccaaagcatattttatcagtgtgacttttttctaaattccctctgcataaatctaatgtatttcagtcactagtattctaactcaaaatacaaaaccagcatttttctatctttaggtgactcctttcaagagaaaactaacctatgatgccacaagtcgtcatagtggccattcttgaggggagcttccacatagggggtgtgaggaagctgctagggtgttgatcatattctgtttcttaaatctcgatgctggtaatataaatatgttcggtttgtgacaattcattgagctgtacacttaagacgtgtactttcctctatgtatattattccgcaacagaatactgctttattatacaataccttttccaactcatatttaagaaaacaaaaaaaaaatcaactcggaaagcttcctatttacatgaaaatgggttgccttatttttctgggagctggtcagcagcgttcttcagtaagttttgaatccccagttttgcaattctttgtggtatttgcgatatttttggtgtttccaatgtctagggatttgtaattgcagaagtatcttgactttcttagcgacagttatgtccatggcttgtcctttttgtaatcagaaggtcatgctaaattatccctgtgttctttactttctactgaaacgtattgatccctttggattttcaggttaaaagaccaatacaactctgaagaatcagaaaccacttaaacaccttcacaaatgcatttcctttctcaaatttttttactttgatttgttccactttgatttggttcactttatttatgccacttgtcaacctacctatctgtgtttctttttgaacactgtttgtgcttccgtatttctttatttcatactaaaaaggatttggaaggaatactgtctcgtttttaggtcctttcgtgttgtggtttgggttaacaaagacaatatatatgcagatacattaaactgagtaatatcagatatccactcagttcacttgataagggaaatcttagtcataaaatgaactgaagacagagagctacagggtcgcctggcccaaggaggaattcatgttttgtgtgcttcacaaaatagttctcatacacttgaaaaggaagccattaaaggttgaattttaaagaaaaaatattgttcttaggatataaaatgccacctgcaacaaagacatggtgtatgttgaagatgaaaggggagaacaacaaaagaatacttaaaaatagtcaaaagaacaagaaaagggaggaaaaagcaagtttctaagtgcatcctctgtaccatctgcattcaccagttttagtaattgtatagggaataatgccttcccctattgacttgcactcccacagggatgccaaactaatagaaaacattttacatgtattctgcactttctaatataatatttttatattatcgaaaagactttaacttgtgtgtgtgtgtgtgtgtgtgtgtgtgtgtgtgtgtgtgtgtgtgtgtgagatcttgcttcgtcacaaaggccggagtgcagtggcacgatctcggctcactgcaacctccaccttcctagttctagcgattctcctgcctcagcctctcgagtagttgggatcacaggtgtgtgccaccacgcccagctaattcttgtatttttagtagagacatggtttgaccatgttggccaggctggtctcgaactcctgaccttaagtgagccacctgcctcagcgtcccaaagtgctaggattacaggtgtgagccactgcacctggccgagttaaacgtttttacacctagaatttggtcaaagaaagagatgcagacaaatagtgttaaaatgaaacataaaaatcaatctatatttattgagtgcatacgatttgccaaatctgtataacgttcctatgtgttgcagttgaacctcacgggagtgctctggagtaataatttgagccccattctaatagtgaataaattgtgcctcagaaaggctgtcacttgcccaagataacacagctagtgagtgagtgagagacctgagttcagaagttagctatttctgcttctgaaacttgggttacttttgctatagtatctataattctatagagtaagttgcaggcaggaaaattagaaccatccaagagaaatagtatgttagattttacctggggtattcatactacagggagaataaaactgagcaccgaaaggtctataaagttacaggctaaatgtagcacatttcactaaaaaaaaaaccacatcagaccgtgggaacgggggtgggggagatttttactcaaaagtacttaaaattacttttacataagtccaggtgtgatggctcatgcctgtaatcccagtactttgggaagctgagggaggcggatcacaaggtcaagagatggagacaagcctgaccaacatagtgaaaccccgtctctactaaaaatacaaaactgagctggacgtgatgacacatgcctgtagtcccagctacttgggaggctgaggcaggagaatcacttgaacctgggaggcggaggttgcagtgagccaagattgcgccactgcactccagcctggcaacagagcgagactctgtctcaaaaaataaatgataaataaatagttttacgttgaaacaagcatatattaaaagaagaaggcaaaatctctaggaatttttagcataaagtatatgctttcaaagaaatttaaaacctgcaggcactgtgtaatttatactgccagactccagggtaaattccttcaatttcatttcctggaaggatgctctggtagaatattctgagaagcactctattagagaatatggtgaatatgactaatagaaattggatttcaattgtgatactttaatatatcattgactctgtgagtttcgaaaataatacgatagcaggaactgtttctctatcacctcactgctttctctctctcggtgccccagctaggtgtacatggaatcccctacctgacctataatcctttactccctctccattttggttacctccagttttaaaagaagacttataaaagaccttggtctatgtatttaagtttggcccacaaagcaagattctgtctgcgtttttgacctttgcctagactttgtctccaaacccaaacgtagtccttgtgtcttggatgctatatgatcctgatggctttgggattcatgttttattctgtactccaagacttctctcacctttcccagtctctgctcctctttttgaataaacagcagtttatcacgcacatacttcttggtctgacagacttcaactttctaccctggattttttcttttcataaaaacaagtatctctgtcagttaacagttaactatattttcttcaacaatggacacattgcagtgcataagattattttttgatgagtttaaaagtcatgctttgctcagataagtgtgaaattttgctcctggccaaaggagggaaaaaaacacatcattttaatggcattgtataccttcattcaatttgaaaaacaaattattacactcaaaataccaaattattccaggttagatatgaagttcttggcagcactattagaaagtgtaaatttattttcttattactagagagctttccttaaagtttcattaaaatggcactgttttaagatttatgtgtatattatgtatagtaaagttgctttgttttagattaaatttatggatacatagtatatttagggggtaaatagatatattgatacaggcatgcgaagcataatcatatcagggtaagtgaagtatctgtcacctcaagaatgtatcctttctttgtgccacaaacattccacttcaaatttttttttttttttgagacgcagtcttgctctgtcacccagggtggagtgcagtgatgctatctgggctcattgcaagctccgcctcccgggttcacgccgttctcctgcctcagcctcccaagtagctgggactgcaggtgcccgccaccaagcccacctaattttttgtatttttagtagagacggggtttcactgtgttagccaggatggtctcgatctcctgacctcatgatccgcctgcctcggcctcccaaagtgttgggattacaggcgtgagccaccgtgcctggcccaaattcttaaatgtacagtaaattgttgactgtaatcaccctcttgtgttgccaaatagatcttactcattctaactagatttttgtacccactaaacattcccactcctcctgtccccaactacccatactacactctggtaaacatcattctactctctgtctccatgagttcaattgctttaatttttagttactgcatatgagtgagcccatgcaaagtttgtttttgtgcctggcttatttcacttaatacaatgtattccagttccatccacgttgttgcaaatgacagcgtctcatttttttttatgactgagtagtactccactacgtatatatgtaccacattttctttatccattcatttgttaatggatacttggattgcttccaaatcttggctattgtgaatagggttgcaataaacatgagggtgcagatatttctttgacaaactgatttcctttcttttgggtatatacccggcagtaggattgctggattatatggtagttctgttttcagtttttttgaagaacctcaaacagttcttcacagtggttctactactttacatccccaacaacgatgtaccaaggttcccttttccacacagccgcatcagcattgatgttgcctgtctgttggatataagccattttaactggggtgagatgatacctcattgtagttttgatttacatttctctgatcaatgatagtgacaaccttttcatattcctctttgacatttgtgtcatctcttgagaaatctctattcaaatttttgcccttctttcaatcagatgattatatatatttttttctatggagttgtttgagccccttatagattttggttattccttgtcaggtgggtagttggccagtattctctcctactctgtgtgttgtgtcttcactttgttgattgtattccttgctgtgtagaagctttttaacttgatgtctcatttgtgcatgtttgctttgattgcttgtgcttggtagggtattgctcaagaaatatttgcctagaccagtgtcttggagattttatcccaatgatttcttgtagtagtttcatagtttgaggccttagatttaagtctttgttccacttagattgatacttttgtatatggcgagagataagggtctaatttcattcttttgcatatccatatccagttttctcagcaccatttattgaaaagatggtcttttcttcagtgtatgttcttggcacctttgttaaaaatgagtttactttaggtctgtggagttgtgtctgggctctattctgttccattggtctatgtgtctgtttttatgccattagcatgcatttttggttagtatagctctgtagtataatttgaagtcaggtaatgggattcctagttttgtaaacaaggatcatttgattcttccttttcaatctggatgccctttgtttctttctttgatctagctaggacttgtagtaatatgttaaacaacagtagtgaaagtgggcatccttgttacagatcttagagaaaagtcttgtagtttttccccattcagtatgaaattagctgtgggtttctcatatgtggcttttactgtgttaaggtatgctgcttctatacccagttttgagagtttttatcatgaaggcatgttgaatttttatcaaatgctttttcagcatctattgaaatgatatggtttttgtccttcattctgttcatacgatctatcacattgattttttgcatatggtgacccatcttggcatccctaggacaaataccacttggttataacgaatgacctttttaatgttgtgttgaatttggtttgctagtattttgttgaggatttttgtatcagtatttgtcagagataatagcctgcagttttgttttctggatatctgtctggttttcgtgtcaggctaatattggcctcacagaatgagttcagaagtacttcctcctcctctttttcacaatagtttgagtattaggtgtttcaatgtttggtaacattcagcagtgaagccatcaggtctcgggcttttcttcactgggagactttttacatctttgatctcattacttgttgttggtctgttcgggttttgcatgtcttcatgacacaatctaattttgagtttggtttgctattctagttctttaagatgtattgtttctcttttttttttttttttgatacaagtgcttattgctgtaaactttgctagtactgatttatctgtagcccacaagttttagtatgctgtgtttacagttttgtttcaagaaattttataacttccttatgaatttcttcattgacccactgatcattcaagagaatatagattaattcccttgtgttttgtataattttcaaaattcctcattactgatttctcagttcattcaactgtggtcagataagatactttatatttcaattttttgaatttaaggcttgttttgtggcctaacatatggcccatccttgagaatcctccatgtggtgatgagaggaatgtacactctgcagctgttggttgaaatgttctgtaaatatttattaggtacatttagtctgtagtacagattaagttcaatgtttcctagttgactttttgcctgatgacgtccaaggctgaaagtggggtattgaggtttccagctctctttaggtctaataatgttgctttatatatctgggtgctccggtgttcggtacgtatatatttacaattggtatatcttattgctgaaatgattcctttattatatgttgatctttgtctcttcttacagtttgtcttgaaatatattttgtttgatgtaagaatagctactcctgttcttttttggttgctatcgacatggaatatctttttacatcccttaattttaagtctggctttgtaggtgaagcgtgtttcttgtaggcaacagattgagtcttggtgtttgttgttgttgttgttgtttgtttttttttttttttttctgtcactgtgttttgattggagagtttatttcatttatgttcagttttattattaagaacttattcctaccattttgttttctggttgttttgtggctttctcttccatcctgtcttcctttttagtgaaggcgatttttctctagtggcatgcttttatttcttgctttttaaattttgtgaatcttagtatatcttcttatttgaggctaccatgaggtttacaaacactataacccattatttcaaacagacaacactggttgcataaacaagaaagcaaagagaaaactaattaaaaactcaaacttcgtctcttttaatctttttgttgtttgtttatatctcattatactgtctatgtcttaaagttattagagttatttgttaactgaaagcttcctttttttactcttcttattcaagatatgagtagttcatacatcacaattacagtattacaatagtttgtgtttgtctgtacttactgagttttgtgccttcagatggtttttctggctagttaaggtcctcttctttccagttgataaattctctttagcatttcttgtagaacaggtctggtgttgatgaaatcccacagcttctgtcttggaaggtctttatctttcttgttggaaggagattttcactggatgcactatcctagcataaagggtcttttccttcagcactttaaatatggcatgacatgtcttagcctgtaagttttctgctgagaagcctgttactagttgttgttaagctttttggaatgtatcttttctcttgctgcttttaggatcctgtctttatccttgacttttgatgcttgccatctaggagccaaggcctgaagttgcatctttatgaatctatctggtgctctcttctattgtggcagagctggcacccaagccacaatacaaagtttgtcccattcttcctttcccatttcataagcagaggaatttttccccatggctaccactgcctcaggctcatggtgagtactgcctggctaccactgatgttcactcaaggcccaagagctttttagttaactaggagtaaacgctgcgaggcctgggtctctccgttctgtgcagtgggttctcctcaggccccaggtgagtccagaaatgccatccaggagccaaggcctgcaatcagagaacccaggagcttgcttgatggtctacctgactgtggttgagctagtacccaagctgcaagacaaagtccactctattgcctctcctttccaaaagcacaaggagtatatccccatggccaccacacttgggaatgcattgggccacacccaaagacagcatggctctgagtcttacccaagacttggtgaatactgcctggctactactgctgcttattcaggacccagggactctttagtcagcaggtgacgaattctaccaggactggattcttctcttcaaggtagcaagttcccttctggccctgggtgtatttaagaatgtcactcaggagccagggcctggaatggggggtctcaggactctgcctgatgccttatcctactgtggttgagcttgtgtccaagttgcaagacaatgtcatctttactgtccctatcctctcctcaagtggaagaagcagtctctctcaaagctgtcagctgcactgttaggggttagaggatggggtggtacaagcactggtgtcttactgggttgtgtgcccaccaagtcccctgacttcgagtccagcacgacaccaagacttgcccaggaattgcagtttttgtagcctagactccctttgaagtttatttaggaccccaaagtgcttgagctcacactggtgagactagctggaactcagcttctaactgctgagatgggtgatacctccctggatagggctggtctaaatgtgccctctatgtgcgcttgatgaattctgccctgtgttgcttcccactgtgacagggcagcactgggttccaatgcaacgtttcacaatcctgcgccctccctcctgcaagcacacagatcgtctacatgagacatggcctctgccaggggatgggggaggggtggtgttggcaattcgtaactgtctttcctaccatcttcagtgcctctttccttgatatgatattaaaatcaagtactgtgattgctcacttgatttttggtttttatgtaggtgcttgcttgtgtggctatctgttcagtttggtgtttctatagcagcggtagcgggaaagatgattgctggaaggttccatgtatttgaccgtcttgttctgcctccctcctagtaaagctattctttaaaaattctagcatgttagggttttgtgttatgttctttttcccatggaatttgaaaatggatctatttgagtagaatttcaaaagaataactcataatttttgtctaagtatatatgtggctggattcacaaagctgggcacacagggactggttggttgccgcaggtatcattgttccctgcttgaagtacccgggcatttacaggtcttgtcattgacatggctacctggttgtaggaatagtctaaatcctatgtttttaatcgtggaagtttaagggatgtcttttgcctggaaaccagggattttcttgacttgtgtgaaattcaaagtttatatgtgatccaaggagtgtatgtaaagagcacagtcacccaaaggctaatgttagacccatcacctgacgttttttggaaagtatttgttgatcccaaggcttgtgagagctcccactgttacatgttctttagtcctttctaatgcttctatgtaatagtaccttttaggaatattttctttgctggactctaagttctatagggtctgggcctatgtctgatgtactagcatatgattcagtacctagctcaggtttattcatgctcaatatgtctttgactgattaaattagggatttccagataggtgatgaaaaagctgggaattacctcatgaggggattgtagggttttaagcagaaaacgatttggtgaagtatgacaaaagaaagacaaatgttagaaagataatcaaatagtaggttataaaaggacaaggaagcaacataagattgaaagaacaagaacccagaattagacagatctgagccataattttggctttaccccattctagtttcatgacaaagagccacatactcatcttacatgagatacttagaggttaagtatgttactgctaatctcagaaatgccacaacggttatgaaatccactcatttaatagtgtgtctcatgagtatttacgttaaaaatgttaaatattatttattgactattatttttccttagtataattcctgagcaaagaactgagtaaaatagatgaaaagctctcacagggttgtttcaaacctaattaaacccgatattcctaaaatttgagttatccagtatgagaataggtcatagcatgcaaaatgtgtatgcacagcaagcatgttttgagtgataaggatgtcgaaccactctgactggtatattccaagaatggttaaactttatgtacccacccaggtagattgtggtcttttgcttctttgtgtatttacttttccctttacccgtaactgccttgatcatgcctgtattttttctctccttcatagaatctatattcatttcagtgaattaattagatcatttagggtataaatctcttactcttgctattcaaactaattcaaatagacttgacctatgataaaatttttaaattttttttgtcatttgaactttccttttttcatccgtcatcttcggcagattaattatgcacactaattatccttaaatatagctttagttttcaaaaggggataatcgtgaaaatgtatcattggaagtgtgctttgttaaattgagtgtattttttttaatttcagtttgggaagcagcatattgagaacctcttcagtgacctacaggatgggaggcgcctcctagacctcctcgaaggcctgacagggcaaaaactggtatgtgacttatttttaagaaagttaactttaaacttagtagaatttcagaccagaaactgacaacatagttttatgacatctagtagaatgactaggtactgattgaaacagcaatacctattccttagtaaagcaacctcgtatgattttcatttggcatactctaccgcctgcagaaaaagtaaaaatttcagtaatacaatttatattaatagatattattcagttttactacttggtatctatcttatcaaatatcttaatgaaggcttttatacataatgacttgagaaattatctttgtacttttgtgtatttttgaagttattttacaaggaacctgtatgagtttatacatgtgggatagcaaaataaggtacaggcattatagtgtaatacgtgatagcatatgtgatgaaaatatcacttcctcttgaactattatcttgtctaacttcagagcattcctgtgaagatacatgattgatatacatgattacagatcagtgaagtcatgttgatcaaggtcttacactggggggggaaagaactcaaattgaaatcccctgactgaaataatcgtcttagattgctattctaaaaagtagagtttaagcccccagtctatagtcataaataactgttctacctatcaaattctgctaaatcatagccttcgtctcttatctttgcccttcattacaactccccagcacatgcacatacacacacagacacacacagattttgtcatattatacaaactgaagctgtcgttcaaagtcagttagcaaaaatcctatctaccccagcctgcctcctgtaacacttaacgctaagccactcttttctcggtatatattgtcagatatctctgggtttttgcctgtattattttacttgcctgtatttctttttgtacttctgtctaccccaactgtctgccagaaaccttgatttcacctcagtaaagcttttcccaaattacctttgctaatttttccctcccaaattccacagaaggcccatttttgtcttgtttttagtgtatgtatgactgacatccctcctcaattaaattctgaagtcctatacagaagagacatacctatgctttcattttttatcttcagctatgtgagattaatactaaaacggatccatttttttcaagaagtctgaacttgtactaatagaagaacaacttgatgacatattgaaataataactttagtcaagggggaaaatcagatttaataccttatagctgaactgtttgctgggcgccaatttgaggtcatcatgtaaacttggtcttaatttcactagttagagatagatttgtgtgtaattcatctcctatgactgtgaacaatttacatatatatggatacgtagcatatgtacagaaatcagtgtgtctgtgtatctcgtttctcctgtattctgaagtcagtcctactttgttaccgaatacagaagtcccagtgtcttccaaatgttcgtgaaaaatctttcaaagattatggcttactcatcttgtcctggccctctgttaggaggctgttgtctcttcacttccaggtatctgcgtgatcacttctcctgtgttgcaatcctctggtcatttccctgactgagtcaatccatctatcacccaaagcaatttagtcagggttaacaaatttcatacataatgtttaagataatgaatttcagatcctttcgtaattcataagcatgatttgggtgtttatactcagatatgagataagcctttctctaaacttatgatgttggcacactacccatttgatataaagaaaaaaccactaatttcggcaaaattaaaaaatccacatgatttgcatttatgcatatacatacatagacgctaagacaaaatgaacctaattagtaatagcattaaagaaaaaaatatcaaacaaaatatccatgagattggccagtataaggtaagctagtggtagggaaaaatcaccaaacatttacacatggcagtgtagattacataatttcagatactgctactaacagaatccattcaccattgtttgtcctaatcacagatctgtcagccctggtctgaggattttgcctttctcataaagcagaatcacctctaacaaatgctcccgatcccagaactccaattcgctatgccttgtcttgaattctaatagtttctgtagagatatatcttctactcctaatgggaggcatgtatactatagaacagaaattttagtattctactcagaagcatctgcatttggattattggctcaggacatccccagggttaaaaggaaggtacttgccttacaatcataaaataagaaatactccccaaggagactctaataggggcagattttaagttcccacttcaggatcagaaactgcagctttttaaaagagtagactatgtttggttctaatacatatgcacatgtgtacatttaatgtttgaatatgatacaaaggaaaattttgctaaatcttgtgactatataattacataattgaaaggaaatatgtggctttggtctaactactaggcagagaactgatttgagtaattattttcaaaactttaaagtcctataattaccattaaacttgtatactgtcaatctatatatacacaagaagattggttatttgctgtttttctttcatgtattttttttttattttgatggaatcttactctgtcgcccaggctggagtcagcgacatgatcttggctcactgcaacctctgcctcctgggttcaagcaattttcctgcctcggcctcccaagtagctgagactacaggcatgttccatcatgcctggctaagttttgtatttttagtagacatggggtttcaccatgttggccaggctggtcttgagctcctgatctcaatgagccacctgcctcagcctccccaaatgtctggctgttgcttttttttttttttttttttttttaaatctaaagtcttatttttttcctctttttggtggaaagtgggagaaatatcagaatgtaaaccaacatcattctgacattcttggaggaaaatctaagaggtaaaaatggagattctggttcataaggttagccttaatgttttgtgaaatcaaaggaacaagatgtcaatactgtgttataaaggatatcaggcaagttaccttggagagtaagatggctttagcttaatttgggttgttcagcaggcagtgcaaatgataaggagttctagggtgaggaactacttgagaaagaccaggagctttgctggaaagtataggagttaaatgcaagacacagaaatatagatatttgtttggtgcatgcacaaggtagttagagaagaaggaaataaatttgcaagactggggctctacagacacagacaaaagtttgggtcctggctccaccaattattagttatatggtaatctatatattagatattttaacctgaggttcacttctgtacaatagggatgaaactaactgccttgcaaggcggggattaaaggtagtgcattcaaagtacttggcacatactacgaagtcaataatatttatgttggaccaactatgtgacaagcaccaatcttagtgctttatgcatatcgacacactgaattctgccagaaaccatatgtacaatggtttgagcaatatgaacaataagtagtgccctggacaaggtctggatcctgtgagacagcatgcttcatgtttgagtgagggctttgacctcaaatgcagagaagaaagtatgtcgaattctcttgtaaatcagagcagttgttattgagagcacatgttgtaacttgtgtatgcctcttgctaatattttcattaagtccatttttaacagatgagaaaactggtatacagggagattaaattttttatgtaggccagacagcacaaaaacagcagagctgacaattgaacccaggcagtcagctttgtagctcttgcccttaactgttacctataatcacccaaatgtttaggtgagaactttgcaagtggtttgcattggcagtgggcttacttcaggaacgtcattgttgatggtatgaaggaaggatgaaaaaaatggtgagtgagtggagaagggaaagaggttagatttctctgggcaatagctaataagggcttgtagtaaggtaaaagaaatgaaaatgagagtaaataaaacaggttatcataatggtagaatttctaaaactctacaacttaataaatgagttaatttgtatattacaatgaactatgcagatgttggtttaaaaattacaggataagatacaacttttgggattgagaataaaattagggaaccaaagtgattgaggtttagagcttcagtgacaaggacaattaaggtaatcttcacagaaaaggtttcctttaaccctatttggcattatataattttgctagagtcaaatctcctttagatttttctaaaaagtttgggaattgtttttctatcttactagaaaatgtttttatgcatgctgatgtttctgtcattggtggtcatgcagtaatccccaactgggctatagaatgaagaaacaatcataccaaaataggctttgtaaagaaaaagtgttgccattcttagagtggttggtttatgctaaaaacgtaccaggccaaggacaattagcgcaaagtatttagattcattatattaatgcctcacaggctctgttcgtttacaatattcaagcttaatagtgaaattataaatggtttcatttctagtagattgtcggtctctctgctggtcagtgaacactcttttgttttgttctcagccaaaagaaaaaggatccacaagagttcatgccctgaacaatgtcaacaaggcactgcgggttttgcagaacaataatgtaagtagtaccctggacaaggtctggatgctgtgacacagcatgcttcatgtttgagtgagggctttggccccaaatgcagagaaagtatttcaaattctcttgtaaatcagaccagttcttactgagagcacatgttgtaattcgtgtatgcctgattgtggctaatataattcaggaagcaaatgcatgctgccacagagggaagggaaaagacatagacctgacctgataggctgctccctgttttcagattttacttcatgaagctgtgtttggtggacaaagtcctgcagtcaactcggtttcttttcttactttgcttttctttttcttttttcttttcttttcttttcttttctttttttttttttttgagatggagtctcgctcttctgtcccaggctggagtgcagtggcgtgatctcggctcactgcaaactctgccttccaggtttaagctattctcctgtctcagcctcccgagtagctgggattacaggcacatgccactatggccagctaatttttgtatttttagtagagacagggtttcaccatgttggccaaggctagtctcgaactcctgacctcaggtgatccacctgcctcagcctcccgaagtgctgagattacaggcgtgagccaccgtgcccggtgaactctgtttcttacggcagtgttttgtgcaacaaacggatttttctataccaaatatttatgtactaaatgtgttcaaacctgataatgatgtttgtttaaatcaagccaacacttattaaacgctgtctccaagcatataaattatacagaaacatcactatttttacttggggtatgaatggcagatttgtttttttggtttagatttaactggattaaaatacgtgtgttgcattagaagaagtaaacagtcacagctaaaccaagtaggcaggtcagaggaattctaatctcctctgaaccacttggtgactcttcccctgtgtcatggcattggaggcagccttcctttcttattaacatcctaaaatctgtctaatcgaccaatacatttcaccaggcacttagtagctccctaattacattacctctctctttcaaagataaactcaagtacattgagtacgttgatcacttactcttaaaataaccataagcagggatagattaataataacatgtactcccccaaatgttgctcagcttatctggcagggagatgacattacataagatatggaaatggaaactgtgcagcaattaattggctgattttatgaattcagggtcattgtcacctttaacctatgaaagttattttacagagatgtttgtcttaggaagaaattaactagatttttcactccgcagccagaataatctatgagctgattttcttgtttattagtccgatggactctttggaaatatcagtgtcattgacattatgagaattgttaacaatattaaagttacacaaagaaaatgtctttgaaatatcaaaatatcatattctgtttcaaaatgtagcagtgaagaaaagagcggaacacagaattattagatttaatttatttgtagcttgactgtccccagcaagaaaatgtcatttaaaaaaacaaactttgggatatcctgtaaaactcaatcctgcataaagaaaatgcggtacaggtcgggcgcggtgctcatgcctgtaatcccagcactgtgggaggccgaggctggcagatcaccagaggtcaggagttcgagaccagcctggccaccatggcgaaaccccgtctctactaaaaaatacaaaaattagctgagtatgctggtgcatgcctgtaatcccagctactcgggaggctgaggtaggagaattgcttgaacccagaggctgaggttgcagtgagtggagatcgtgccactgcactccagcctgggaggcagagcgagattccatatcaaaaaaaaaaataataataatttggtacatatacagcatgaaatacaatactatgcagccacagaaaagaattagatcatgtcctttgcagcaacatggatgagtctggaggtcattatcctaagtaaactaacacagaaacagaaaaccgaataacacatattctcaataagtacgagctaaacactgaatgcacacgaacacaagggaacaaagagccagcagcagctagtgctggggaactttgagactcctacgtgataaatcatgaaagggtgtatggggggggtcttacttgcaagtatgttttgggaggttttttgggcacacatgctctggttgtacatgctagcacacataccacatctcattggcatctaaaatctccacccaggggtgtgtgggtttttttgtttgtttgtttgtttacactattacaatgagcaaaagaatagggcaagtttttggaggagtgtgtgcatgcttgtcagtggggaaaatccctagcgtggttatctctggcgagggcctgagaagtcccctttggggctagaggagcccaaccacaaggctagacataatcagtgtggacagtgtgtgtattcattgtccgtttcgctgattgtcaacaggcagcactgactcagtgaaacagcatcttcaggacttcttttctcaatggggctcccttgcctgctcatttctggctatctgcctactccaagggaaccagaaaaatcctggcaataaaacatatagaaggaaatttatatgactttgggataggcaagtatttatgatacctgaatccaaagcatgtttcaaaaagagaaaagttaacttggacttcatcaaaattgagttattgctatattctggatatgagccctttgttttgagttgcaaatgtattttccttttctgtggattacctttttactcacttcaatggttaatattaataaaaacaagttctccacttggatatagtttattctttaaaactttatatttttatgacctgttgaagaaatactggcctacccaaagccattatgatactatattaggttattatctatagaaccattatcgttttaccattttgtttttggatctgttttacctgaaattgattattgcatatggtgtgaggaataggttaagactcagtatttattttatttgaagtctaattaacacaccatttattaaaaataatgcttcctcattgcttcacagtactaagtgtgtcattaaaaatttgtccgtacatatgtgggtctgtttttgcacttcaattctcttgcattgttctctctctctctacacacacaaatatcatgtaatgtggagtaatgtagttttataatacagcctagtatctggtgaactaggttctcccactttgttcgagattttattggttattggccctttctatttttgtatttgttttgtaatcttttccatttacatgtacattcattttaagtatgattaacattgagttaaatctatagagaataactgacacatttacatatggagtatcccagtcttctgtttttcttgattttttttttaaattttaggttttctagaatgagaaactgaaattgaacaggaacacaaaaggtgttcacaaattcaagaatcatatttaagaaatgtttaacctcagcagtaacttgaggaaatttaaattagagctgtaatgagataccagtacaaaattaccaaaatgactgaactagactactaatgccaaatgttgatgaggacatggatcaactggaaatctcacaattaacttctggaaatataattcaggcaactaattaaagagttgggcatgatctactaaatgtgaaaatgcacatttcttaccacccagcaattctattgtagacatacaagttacagaaatacatttcccagtttgccaaaaacacatatatatgtgagaatgttcatagcagtttcatttgtgatagcccaaactggaagtgactatgatacattctcatgatgggatattacagagcaatgaaaatgaccaaatgatagctacacacaatatacaagatgaagtcgttaaaatgtatttgagtgaaataaatcagacaaattatacctactatgatttctttcaattaaatttcaaaaacgggcaaaatgtttccatgggtttaaaattgaagagagtggttaacttttggaaggagtaagtcagtaaaacgcataagagaatcttctgcggtgctcactgttccatgttttgacctgatagctgttacacatgtgtatttactgtaagaaaacgcatcaagttgtacacttatgtatatttttctatatgcatattccacttcaattaaaagaggaacttatgaagggaacttaaaacctccgaaactccacgggccatatatagaaatctgatcatagaccccatgttttctaatgaaattattaaatgaatataagtgaatataaaattagaatatgatgtcatatgaatctcttcagggaaggccacatttcttacagaaaatatagaacctcctaatgttttagtagggaaaaggccccaaaataatggcttaaatttgagaaggagttgttcaaaagcagatattaacaatgctttcatctgagctagagctttaatggggagctgcataagatgctggcctatgcgttagaggacaaaacctcaagacattctcatgcagaaaccaaacttggaacaaaggaacctttaccttagcctgtggctgaacaataacacatggattttcaaaagtaaatctaggctgggcgcggtggctcatgcctgtaataccagcactttgggtggtccaggcgggtggatcatgatgtcaagaaattgagaccatcctggccaacatggtgaaaccccatctctactaaaaacacaaaaattagctgagcgtggtggtgtgcatctgtagtcccagctactcatgaggctgaggcaggagaatcacgtgaacctgggagcagaggttgcagtgagtggagatcgtgccactgcactccagcctggccacagagtgaaaaaaaaaaaatgcattatcttataattctccattttgtcataagtataaacaaaaatggaaaacatccataagtacaactttagtttgcttattaggaagaataaatcaaaatgctcaagcaggattttttttctaaagttgagcttgggtgtgttctatatcaataagcctgtgcaggatataaataatcacattgaagaagtcctatccaaatttccttttaaaattcacaggtatataagttgattgattggtgtcagagcaaacacaaccctttgtgtgtcagagattacagccacatggtaggcaatatgaagcatatatacttaggaacagttaagtgaataaaaaagagatacatagaataagaggtctgagaagaccttttggttcagttcctatatgagcagagacctggagaaagggagtgagccttggaattgtctataggaaggtgggttaggcacggtaataaagaccttaaggtgaaaaagcatttggaatgaggcctcagcaagtggagtagagtgagtttagagataaaggaaacatagcagagataggggagcagagaggtagtaaggtgggggtgagaagaagaaagcatggtgagccattgttggcatttggactcaggtctaaatgagatgacaatgactaaaaaaacactactagaaattaaatgggtcataagtcaggttattttaaaaatcagtaatagttccaagtctttgctattgtgaatagtgccacaatgaacagatgtgtgcatgtgtcttcatagtagaatgatttataatcctttggatatatacccagtaacaggattgctgggtcaaatggtatttctagttccagatccttgaggaatcaccacactgtcttccacaatggttgaactaatttacattcccaccaacagtgtaaaagcattcctatttctccatattctctccagcatcttttgctgactttttaatgattgccattctaactgttgttaaatggtatctcattgtggttttgatttgcatttttctaatgacaagtgataagcattttttcgtatgtatgttggccaaatgtccatcagtgatagactggattaagaaaatgtggtacatatacaccatggaatactatgcagccataaaaaaagaatgagttcatgtcctttgcagggacatggatgaagctggaaaccatcattctcagcaaactaacacaagaacagaaaaccaaacaccgcatgttctgactcataagtggtagctgaacaatgagaacatatggacattaggaggggaacgtcacacaccatggcctgtcagagggtggggggctaggggagggatagaattaggagaaatacctaatgtaggtgacgggtctatgggtacagcaaaccactatcgcaggtgtataactatgtaacaaacctgcacatgtaccccagaacttaaagaataataaaaaatataaaacaggaaaaatcagacaaaatgaaaaatcagtgatagaatactaacaaacttagagtgtcattttattcaagaaagttacagtcaataacgaaaacgtatcgcacagtagaaatgctgctaaatccatgaagaaaaattgatggaaatatatttttagagccattaattcaccactgtcaagtttatgacatatttaacagcaaaagattgagagtacaaataactgtaggtttaatagtgattttctgtatctcaacactaaagcatagtagatacttctataaaatatgagcattatcaataaatctccctatgaagttggatgtgcaagaagagcaatagtttaaaaatttcagttacattaactaaattcaagtctgaactctcaacaaggcattcagaaaatcgtatgtctgtcattattgggaatgctctcccctgagcctatggaatggccagagctcagtagatccacatggtgtctttcatagggcaaaagcattttcattttcagttcattgaggcaaccaagtgatacattcactatacaattttaaggtatcttgtgaagtcaagtgtattaactgtcctgatattaaacacgtggcatacagaaaaagttgaagagagtgtaatcaggggaatatttatagaaacgtggggaggattaaaggaagaaactatggtgaagaatgcagggattcacatgagttaataacctttactacatctaaacctaagcagtcaaggggagagggctattaatttgataaaatccctcatgttgggagagcgccactggacacaactgtgaactgagcccctaggtatctaaagaatgctgttagtttcaaatcattgcctggtgaagttgagagaagtgataccttagtctctccatagaatcctccagtgttttgccagtgccgctccttagtttagtctaaccagaagtccaaggttaagagattccaggtgatgtagtcatcacatacaaagaagaggtgaagaagtttggtgggttagtgaagtaggagtggaaaacggtataatcggcattccaggtatctagttctgttttgtttctgtgcgaaatgaggacttgagaatctgcatgccgagaactctgatgttggctagggcccagtcttgttggatgcatcaggaagccagtcacctttgaggccataccacttctatttgatgacagagagtagacgtggtttctggctaatttggggactaaggactccttcctattcttctggagacaaccagagccagaaaagaaagacacgctgagagtcacttcggatatctgctcttcgtcgtaaacttgttaaaggcttaggaaaatagtaaaaaaaatttcctgccacatacacaaattataaacgggcaatatatttgaatgcagtgaaaatgtcattaaatacacacaaactttcaaaattcatgttatttaataacagtagaaactaataatatacttataaattaagtttgattaaggtttgttaaaccaagagtataaaactacatttgtgaaggaaaaagcattccatatgaaaacccatgagaaatggctcaggctgtactgagagtttgaatttttgtctttgattttgatcttcattaaaaagataaattgaatcaagctttcaaataaaaatgttacaaaaatgctttaaggaaagcaggaactaaagataaagaaatagaagaaacactagataaaatatacagctagttccttataatatgaaatagattaatatcttatgaatgtgatccagacaaggagggagaaaaacaaatgtatgcagtttaaaaatggaagggaaatattaagtatgagatatagaaaccaaaaacgggttttacacagaaatacatatatgtttattataaaaaatgaagttgaggccgagcgtggtggctcacacctgtaatcccagcactttgggaggctggggcgggcagatcacctgaggtcaggagttcgagaccatcctggccaacatggcaaaaccccgtctctactaaaaaaaaaaaaattagacgggtgtggtggctggcgcctgtaattccagctactggggaggctgaggcatgagaatcacttgaacccatgaggcggaggttgcactgagaggtgatcataccactgcactctagtctgggggatcgagcaagacttgtctccaaaaaaaaaaatttttttttgaataccagtgataagtttgtccacacaccaagaaattgataattgctaatagaaaatcatatgaacagcctcctaattctataaacctatgaaaagaaaccctggtttaaaaaaatcactcaaaatttagccctctgatttttaaaggaatattagaagtgtcttttcaaaatgatactttttggtaatttctggatcattaagtcaaggtcattttgtcttctctcttttccttagggtctcctccattttagcctgtccctctgccataaatcactagttctagcatattctgtagttctaaactagctcctcagtttaaccctgttcctcagtttctttcctttccctgtcctggcgtttaacctgttatcctcacttgaatgccactcagcttatatctgtagagctcagacactacgtctgtgttccaatttgcattctttgtggtggctgttttagcatgaagttatccctgctgtcaataatgtattttggaaagccacttattgagaagaaagtacttctaagtgcagtgataactttattgcggtatttgctgagagcaaagctcatttgtaatagttggttgtgattttaaaaagcgaacaaaatacaaaatcctgagaaatgggagactatgctactaagtggttattcttgtctctacatcagctctaggtaaaaatgtatccacagcttctttttatttacaagtttttgaaggtaaagcaaatcccagctaggatgaaacatctcttatacagccattctattatttctttgccctgtcccacttttgtttgtaagtagtgcctttcattaggcattttaaattcagttctacacttaactctattctctcaaagatatttaatgggtaatttaaactttccttggatataactaagttctaatcagtgagtattctctattagatatttgcacttttaataattttgtgtctagtttaatgattaattttttgtctggtaaaggaacttagaaattacaaatttgatagagatttaactgtggtgctttaaactaccccccgctccccaagatgtattatgatctgtcttcctttctccaagcttgtgtcctcgtcttccctcttatgatttccttgcttacattttatgaattccgatcccttttataaagattcatacaaaaggtatagtgttgaaatataccctaggaacattaccaagacttcgctgacttaatataatttaatattaactgacacagttgtagatctaataattatgttcattgtaccagctcatcaattgtctatcacaaggtggtaagtttttaccaagtaacttcaaatctacaatgtgggatactacaaagcaaatagtcattgctatacattaaatcacaaatccaaggtgagtatttaaaaagcctagggtggaaattcagatgacagctatgttcaaatattcacttaaccccatcattgaaaatagtcactgaattagattgaatggttgtcagatgtcactgatctgaaaaatgatatactgttcacatgctggcatataatgttagataaagaggattctaaaatgttctttaaaactagtattttatgtgtcctttaagtattcagaaacttaaatagccatataatacatattttggagcatgtcagaatatatttgactataaactacttctatttattactcataaaatctagtatttaagtacaaattccaaatttaatttgttagacaagtatttcttacacaaaattgtcagtccacacaataggcctgtaaaatatttgcactttatatgtattaattctcaagtttgcagaagaggtagatcttgttaactctgtaacttatcaactatagggtctttgccaaatgattccgtgactttgactcactttatcatctgcgaaatgcattaatagtaaatgttcacttctttcaaaatacttgttatggaagatacaaatatacaaacataatctcgtattcattaaactcacattcagttgcaaggtaatataactactcttaaattgcagcatgttctcatttaaaataattttctgggtgagttgtttattcttcccatcccccttagtatacctcttgctttaagggaaattagtattgacacatttcttgtatattcaacttcaaattgagatagccagttacctattatgttcacatatggaggtctgctgggataataattatataactataaatagtactgtttaaaaatatttcttataatgtcactcaagtatcttttaagatttttattgtagctattgcttttttttttttttttttacttgaaattagtatacgtgacttgagcttaaaaagttggggctatatgggttgatttttgtcgttaaagttacatcctatattgccagataaaagatacgtaattacaaaaattcaaattaaataatatactgaaagtatatatatctttcatactaaattgtgaaagtattgaggacagtgtccatttactcaggcaatgccctctaatatatattctatataaggaattttgttgagtttagttaaaagagctactttcccaaaaagtttagtttgcattttattaatacgttcaaccagattacctgtatcaaaacttctattttgataaatttgttttaatgtctttcatgccattaaatgttcatattttcttaggattatgagacacttgtattaactgcctcaattctttattgtcaaagaggcagtatataaacaaatgaaaacatgactccattaaaaataattctcctgcaatgtatcagagtgatcataaacatatctgaaatatagaggaaatttaacatttcacttgtccataagcaatttgttgaaagtctattttttaaatttattcttaacattctatgcgtggcatatagtgagtggtcaaaaatagttaaagaatgactaaatatgtaaaacttaatcattgaaggtagagatagtatctttgtagtgagtacccagaattaaatcttgtaatatagttgaggtcaaaatgtgcttcaaaaattatctaatgtaaatttctatatctgaatcaaaaataattcttgaaatacggagataaggaagggaataaaaagctgtcattggaaatccaggtccacagtggcaatatggcccaccgtttaggttgtatatatcgacgtatttatgatttaataagaaaaagattcaatacatgcatctctcaatggaagaaaataggtatgatttatgcccataagtcttgaaattttaaacagtgtaaatcttaaatgtggtgtaaaagcacatgctgcagggcaatgaaactactttgcctttcctgtattttttatctttttaaaatgcattatatttagaaggattgtatgaatacttgagaagtttctcttgaatatggagaagtctttagcttggctacatgatggcagacatcttataaaagacatttaacatgtttaaaaagcaaattctgtttatctagaatgttggaaggaacttctcggtttatatatattttatgagaacgaaatgaaatgaaaagaaatgaaagaaccaaatagatggtggaagtacatgcttgaggtttcagtgtcaggaaggatatttacataataattttcaatgcatgggatttcccttttagttattgtttaagattctgtttaaggaaatcaactcaaacttttaaggatatttcagggttcctttcagaatctttttgtgaaattattttataatagtttgtaccatttcatatctagttaaaatcaccaagactgagtgaaaaggtagcttacccttatccccctcccttagctaattttaaaaatgcttgtattttacactgcatatgagggaacaaaagtgactccttcttaggacaaatatcaaactctgaaatgatctgggagaaccaattcctttgaaacaaatgtgagaaacgacctgctttagtctaatttcaattggctgaatgacgcaggacgtgttttcattagagcctgtagctctgaaatgtccttgtcactggttgtctaaaaaggcaagaagaggcagacaccatatattataaagatgatggttcccctgtgaatgagatataactttctgcaacttccaagttaaaaccgcaaatgcttaaatgatacacaaaactctaaacatccatctctctctgcatctaacaaaaataaaattgtatgaaaaaattcattaaagctttgtcagaactttgtcacctgtctttttctctctctcatacacaaaccacacatcacacacacacacacacacacacacacacacacacacacacacacacacgtaaatatcttacaggaatgtaactcttagttttattcatcattttcccttctctctctccttctgctctgccctaagaacttccattttcattatttgacttggttattgaaattattttcaagttacatgcccctcattctgacgtcttatttactattttctgtttgatgaaccctagtctgctattcttctttctgtaaagcaaatcaaaaataacactaacttgttcctgtcaataatctttcagaaaaccatcatatttcaggtttactttcatcttaagtttttcttaagtattcttaaatcttgaatatatcaatataataagtataaatccttttactgtaaaccatcatgggatatctaatcttagcttgaataaaatattgacgatggtagaaattacatccatgttcctgaaggaaagtgggataaaagaaaacagcgaggttttttgcctgtctcgaacaagcaaatgacgagaattgttcctcatagcccagtcatttaggaggtagagtacctggaagtaaatgctccctgaaatgattatatattaatcttagaattactaaatatatattgttatacaaaattatgtattgtaagtactagtctggcgatagaagagggacccccttaagttcttgtcctatgcctttaaaatagacagcaggagactactccatactaaagaataatttaatgtattaggttttctatgtgcaattcttacagactgcttattgtaacttgaggtgtttctaaagagttcacattttaatattctactggagtcacaataagtttccattatgtcaaagcaaaccatggaggttttctatcctccaaaattacatttgaataaagcaacttccgaagataacagtgtaaaactctgagacagcatcccatgttactttatgagtaaaatcttaggcctgttgacaggaactacaaaagccaattgtgctgcgtagtttaacttatttctgcaaaaactcaaggcatgttattacattttcacacagaatatcaattttcacacctattttggtatcagatgttttcattgtgcaaaacaggaaagcagaactttgggtaaccacagtgaccctactatttaatttccaaccatagagtgcttgtcacaacactgatacacacagtaggctcgtacattaacatacatgtcatattaatgttttctgttttgcttagtagacagatgtaatcattcacttcacacagattttaaaaggttttaatatttttaccattcagttatttagcaattagactgataattcttgaaagacataattctggaatgtgtattagaaaaaaaaacataaaagagaagttactgtatggcagggtgatgattatttaagaggaaatagtactgaattcagaaaaatgttatgacttacagctaatagtaagaaatacagcattataagagcaacaagcttatgagaattcatggccaaaacagaccagaccgtcaatgtgaggcattgaagagtaatataaatgccatgaacaataccctttcaggcatgacaaatacctccctcctctagagtcttcatggttatcaattagcatttcttacactccttggtagtttgaagaagacatgtacaagagacaaaacacaaccaaaataaataataatccttgtctgtatcatggtgtgaaatgtttattaacttggagagagagcctcttaaagctttttgtggagaattcactagatgtaattaatgaaatatcttctatccagacatagttttaaatcagaccttgtggaagcttcatttatctttgatactctgtttccctcttggtaaaatgcacataaatgtaaaatgttcatgaactcttggtaaaatttatatagctcatacatactctaatgatgtaggcatagtgaaatctgtattcagagagaactgtatagccataagatttttaaaagatggaaataaaagaagtatgcatcttaagaaattgtaaaaatagaaacaaaaataaaaattgtattcaacgtagaaaattgaataagaataatccattcaaaagtgagctcttgaaaagattaacaaaataggtaaacctatcccagtcataacaaagaaaacttagaataaaaactagacgagataaatgagaaaagacgcatgacagcagatacagaagaaatgaagtggaaactaaaagcaattttataacaattttgcaaaattctggaaaacttgattttctcgtacaatacaaatcactaaaattgagataagaataagtggaaaattagactgattacttcagaaaacatttagtaggttattaaaggtgtactgttgaagagtgtagtaggattctttacaaatgaatttaacgtaacccttaaagaataatttatatactttaagctattccaaagcatatgaaaagaaaaaaactccacaattccttttgtgatgtcaggttaacctttgtacttaacagtcaaaaagcaaagatcataaatctgtaagacagttttacttttgaatgaaatacaaaattttgttgaattataagaaatataatcacattttgcaagtggtaagcattctacaaatgttatctcttatttaccaagagctcttaaaattcaagaaggaaaagaaaactaccatatagaaattaatgagcaaaacatattaacagacaattcacacatggaattgtaataggtcagtgatacaaaaatatattcaaatgcacaaggaatcatggaaataaaagttaacaaagtgatgtatttgatcatacaaacaaaactaaaagaatcaaaaacaaaacaaaaatttcctggtgagagaagagcctattcttatacattctggttaaaatatgtaattctaaattgtttctaggaaggcaggtggaaacacctactaaaattacatatatatgtgtatatatgtgtgtgtatgtatatatgtatatagatgtatacatatgtatatatgtgtatagatgtatacatatgtatatatgtgtatagatgtatagatatatatgtgtatatgtgtagatacacatatacttgtatagatatgtctatatctccctgaaatgatgcgtatatatatatgtatagatgtatctactagagcagagtgtgtgtgtgtgtgtgtgtgtatacacacactctgatccagtatatacatcctgtgaattgttataataacagtagaagcatcagtatctgaaaatgtatgcataagatattggccaggtgtggtgactgctggtgggaatgttaatcaattctgccattgtggaaagcagtgtggtgattcctcaaagaagttaaaacagaaataccattcaacccagcaacctcattatttggtatatacccaaaggaatataaattgttctacgataaagacacatgcacatatatgtttattgcagcactattcacagtagcaaagatggggaatcaacataaatgtccatcaacagtagactgattaagaaaatatgctacatatacaccatggaatacaacccagacaaaaataagattgtagcaacatggatgcagctggagccgttatccttagcaaactagtgcatgaacagaaaaccaaatatcacatgttctcacttataagtgggagttaggctgggcgcagtggcttatacctgtaacctagtactttgggaggccgaggcgagcgggatcacctgaggtcgggagttcgagaccagcctgaccaacatggagaaaccccgtctctactaaaaatacaaaattagccaggcgtggtggcgcatgcctgtaatcccagctacttgggaggctgaggcaggagaatcgcttgaaactcgggaggcggaggttgtggtgagccgagatcgtgccactgcactccagtctgggcaacaagagcgaaactccacctcaaaaaaaaaaaaaaaaaggggagttaataacaagaacacatggatataaagtggggaacaacagacactggagcctactcaagagtaaaaggtgggaggagggagaggatcagaaaaactacctatcaggcaccatacttattacctgggcgatgaaataatgtgtacattaaacccccatgacacgcaatttacctatgtaacaaacctgcacatgtactcctgaacctaatataaaagttaaaaaagagtagctgtctgccactgaatacaattctgtccctgaatataatatctccaattcccaatcagttaattaccccctagtgatctgaatgctttctggcatgctttctccacctgatacttttcttcattccaatctattttttctttacagatttaatcaatactgagtacatgaatatatcttatgtcttttgcttatcttttcacaatgttacttcctttttcttaccccttgggcttccgtgagacacagttgcctacctaattgtttttcctgtggatatagataaattttattggaaaaaaaccatgaacatttatttaggtattatctgtggctgctgctgtgtgtgtgtgtgtgtggggggggggtgcgatgtgtgttccaatgacttattttttattgtggtaaaatacaaatgatgtaaaatttaccatataactattttttattttttaattagcaaaaaaaattgtatataccatgtagcatatgattttttaaaatatctagatgttgtggaatgcttcaagctaataaacatatacattaacttatatgtttatcatttggggttgaggacacttaaaatctattctcttagcaattttcaaaatacaatattgttattaaccaaagtcagcatgttgtacagtagatctcttgaatttattcctattaaatgtaatttagtatcatttgaccaacatctgcctaaccctcctcctccaagctctatcccctgctaaccaacattttactctcaattctatgagctcaacattttaaaatttcatatacaagtgacatgatgtaatgtttgtctttctgtgcctggcttatgtcatttgacgtaacgtactctagattcattaatttcattgcaaatgagaggattctctgctttttaagtccgagtagtattccagtgtgtgtgtgtgtaggtctgtatacctgcattttctttattctttcatctactgatggacacttaagttgatttcctatcttcgctattttgagtagcactacaatatacattgaagtgcagttatttctttgacatattgatttgtttcctttggaatatatacccagcagtagaattcctgaattatatggtagttttatttgtaattttttgagaaacctccatactgtttttcatgactacaataatttacatttccaccaacactgtgcaaagattcctttttctccacatctttgccacaacttaccttttgtctttttgataatagccattctgtgtgatgtaatatttcattgtagttttaatttgcatttctctgatgattagtgatgttcaacattatttcatttatgtgctggccgttggtttgtcttcttttgagaaatgtctattcaggttcattgccctagatagggtttgaggtatcattttttctatttttttagtgtataattcagtggctttaagtatatttctgttgttgggtagtcatcaccgctatccatctctagaatgatttcatcatcccaagttgaattcatactgattaaacgattactctccattttcacctcccctagcctttaataacttccattttttctctatgaatttggctattttaggtacctcatataagtagaatcatacaatatttgtcattttatgtcttgcttatttcacttagcatatgtttccaaggttcatttatgttgtagtttgtatcagaatttcattcctttttaaggctgaaaatattccgttgtatgtacataccacattttgtttatccatttatctgtagatggacatttgggtgttctcacattttggctattgtgaataatgttactatgataattggtctaccaatatcttaatctctgtttttaattattttggttataaacatagaggtagaattgctagagcctaatggtagatacttttttattatgtgaccttctgttgtgaactttttgacactgggggggtagtaccttactttcctttatcaggtctgagcccagtacctgaatatagtggaaattggaccttatgagaccttttatgaggacaaggaaatggaggaactatcttcctgcttacacagtgacaagtcttatgacagtggataaggggttactggaatctaagttcctattacttgatctaagtctccccagagtcaggtccatggcaacccaaaacgtatctaccagcagtgcttcccgcagtatgagtgagtatgtttcctaaaaatagcatattctctgcttaactgcttgagtctttagtgctatatcatctgattgtcactatcactagaattaagtttcatgaaagcagaaggtttttacttttacatgctcttattacttcattgcctggcagatagccaaaaggtacttgttgagttagtgaatcaatgaatcaatagataaattcatagtggcttttccttatggaggaatttctctcctctactgccatatgaggaatccccagatgatgatgcagatgatgatgctttcttattcttgaatgatcaatctccccttcgatgtagtaacatcttataaaactaaaatacgatatcatgaccaagatgtcaacattcataaaaccaccaatagtattcagattttcccagctttactcatatttatgtgtatgtgtgcatgcatatgtgtgtatttagttctatgcaacattattacgtgtgtaggtttgtaaatccaccatcagagtcaatatgcagaacagttccaccattacaagggtccctcatattgcccttttataagaacattcagctaccccacatcttactcccattcctgacctctgccaactgctattctgttctctatttctgtaactttgtcttttcaagactctcatagatacggattcatacagtatgctaccctttcagaatgactttttccccacttagcataatgcccatgaaattcatccaatttgctgcatgtatcaatagtttgttcttttcattgatgagtgttattccatggtgtggctgtactatggtttgtttatctacccctgagggcatctgggttcccagtttggggctattacaaataaacgtagtatgaacacttaggtgcaggtttttgtgtacacatgtgttttcatttccttgagataaatgctcaagagcccaattaccagattgtataataagtacatgttcagttttgtgagaaactgccagactgttttccaaagtggctatatcatttgagtttccactagcaggggttgagtcatccagtttctccacaccctcaccagcattttatggcactattttttaattttaaccattatgataaatgtgcagtgatacattattgtggttacaatttgcattcctctattggctaaaaacattgaacatcttttcatatgcttgcttttcagatgcttgtgtttaactttactccaccttaaacatttgaggagtgtgaaggacaggagacacagagatttgccttgattaaggcaaataaaaccctgccagattttcatttccaaacacagtcctagacagagataagagagctggcagtttgctccattgtttattagagacctaacattcattctaaaacagaggcgttttactaaaatgcagtcagccttaattataatggcactccttggagctaggtggaagtactggtgaatttttctgagttgtaattccatactagaaagcatatcttaattttaaacatactttatgacattttatttggagatactccagttgacctctttaatctgcagtaatctattcatgtgctgaaagtaaatatatttggggtgcttgtttgttatggaaagtgattttacacatgcattttgtttaatttttagattattttcaaaaagcttcaatgctaagtctctgaaaatagctaaatgcaattaccttcacgtttttattattattattattgcaactaggcatttggtctcttaccttcaaatgttttacccctttctttaacaggttgatttagtgaatattggaagtactgacatcgtagatggaaatcataaactgactcttggtttgatttggaatataatcctccactggcaggtaagaatcctgatgaatggtttccttttgggtaacattaatcttgttttttaatttttacccttgacgtgtgaaacaaatgtgtatttctaacaataacaaaccctgctccatagtgctgctttttaaattgacactaccatgtcgtctgaaatgttaaggatcatcacggtataaaataggttctggtacatttacaggaatatttttcaaaattttatttcattgagtaagtataaggtaaaaatacaaagtcccaatcataggtgagtaatttttttcacaaatgtatgttctataacttgtctataagttaatttagtatgttttattttaatcactaccaaaggaatgaggctttctcagtcttgggtattcttaacataaattattgccaataaaagattagtagaatatgggtatctctatcaataaatgtgtgtaatacatacaaactccataatgtgatttggaaattatttttaagtcacctgagcatagggtcttccgactgtctatttgacctctgcaaaatgggttgaaggatttgtggaaaagatacagacacacacccgtgtgtgtgtgtgtgtagtatatatgcgtatatatataatgtgtctatatatacacacatatatacaatatgcatgtgtgtatatacacacactcatatccacacattatatatgtatatatatacacactcatatccacacattatatatgtatatataagaccaacatgaacttatatccactaatattatccactcattgtatacatatacataatagtataatcataatatgtatacataatcatacatgaacttatatccactaatattttccactcattgtatatatatacgtaatagtaactcgttatacacatatgtataaatatgtatgtgtatatatatataccaacatgaacttgaatttaaacttccacggttaccatcttagtggcatttggtatattgccacccctgttctgggccatggtcccttcactatcaaaagagtaaaaataaaaataaatgtgtatgtatttcttatcacgattaagtgggagaatatctgcaaggcactcagtgtagtataccacttttatttgaggtgtatcatatgacttgtattgattgcttaaagttttccactcatttaaaaaatttggaggctgagaaatgactgctgtttttactggtcgggattacttttttataaatcagcgtttttgaaatgtaattgttagaccatcaatgtactcattctaagtgtaaaattcaatttgcatcaatctggtttagttctggttcttggtagcctctcaaactattttgagggatgaataactcccccccaccacgttcattaaaatttgcaggatatttacagagttatatagccatcatagcgatctaattttggcacttttccaccaccttaaaaagaagtttcttctccatttacagtcatttttcactcccaccccagccctaggcaattgtcaatctatttctgtccatatgtatttgcctttttggatattttatatcaatataatacatgttcttttgtgtctggcttcttgcaatgagggtaatagttcagatccagccctattgtagcagatatcatggcttcattcggtaaacttgaatttttttattttttatttttatttttttttatttttattttgagacagagtcttgctctgtcgcccaggctggagtgcagtggcgcgatctcggctcactgcaagctccgcctcccggattcacgccattctcctgcctcagcctcccgagtagctgggactacaggcgcccccccaccacgcccggctaatttttttttgtatttttagtagagacggggtttcaccgtgttagccaggatggtctcgatctcctgacctcgtgatcctcctgcctcggcctcccaaagtgctgggattgcaggcatgagccactgcgcccggcttgaattttaacttgaattgtagattgctcttgctcagagtcaaatagtgagtagacacaaagagtacctattaaattcagcagccatgttgctctcctaattggcccccatatatttttattccaaattctctgaacaggcttaatgctacttcacaacagtaagcggggagaggggaagagaaagagcgggaattaatatgtgctggcaacaaagaatagctcataggagccttaagtgagcccaagttggccgattttcagcccgttccatatagtgatggtgtcaaatagaaccagcaagcaacataccgcatctctccccaaactgcttttcatatgttgctcagtacttctcaaaatatcttgaggaaggaacacttttcccctaatccattgtatgtaagatagaataaaaccaaagcgttacaaaaataagatgcccaacacccatgcttcctcctttattattaaatacattagacataaatggtactctgtaaaatcgctacataagtttcttgatgcactctgaattgttgactttatcttatggcatagtaacaaataattcctagagtgaatccagtttgcagatcccgctttgcgtaagacagatgtaagttttgacaaagccagcagaagaactcaagcatgcacagagctccaaaaggcactctgaactgtatttattgtttatactacttcttatatgatcttaccatttttaaaaatatcctgaagccctttccaactccatctgaactagtccaagataagctttcaagactattatgtctgataatttcttcacttgcttgcaagttgttcatttattattatttttttattttttatttttgagacagagtctcgctctgtcacccaggctggagtgcagtggcgcgatctctgctcactgcaagctccgcctcctgggttcatgccattctcttgcctcagcctcccaagtagctgggactacaggcgcccgccaccacgcccggctaattttttgtattttgttcagtagagatggggtttcaccgtgttagccaggatggtctcgatctcctgaccttgtgatccgcccgtctcggcctcccaaagtgtttggattacaggcgtgagccaccgcacccagcccatttttcattattagcatgtggaggcgcttttgcaatgaggaatatcagaaggaatgctttttaaatctttctttgtctgagacctctcttatagcctgttgtttttcatttatgcccttgaatcaccatatccttgagactgcaagactgtagactcttcccagcctctgcttacttatctcatctctcttatatcacactgccctgttctaaaactattaagcacactttgaaaaattatcttgctcagtgttcatcataatccagtgaatctaaaaatgtgtttttcttttttttttttttttttacaccaacattacatattttcttcctattaaatggtagaagcccttgaatttcagcaaagattaaaggacattttggtcaacttaatgtacattctagatctatcagataacgagcggcatttacagatagaaccatgttggcccctttttctaatgcaacatactatgttattaatagtgccatggaggacttctcattgaacttgtgaaaactcaggaatgcaaactctgttttcctattactgtttttctactgtccatctcaaataaaattgctagcctaaaacagtaacgcatattttgtaacataggcaggtttgaacaaaattgcaaagcatataacatgtgtttggcatctttttcttccttcttaagtgcaattctttttttttcggagtgctaaacttggctctggcaaccagctggttgtaataacaaatcttgctaacagtggtgagctatcagaagtcaggtccatacttttactggacaattcaagggatgtacttaatggcaacgctaattcactttagaatgttcatattattgatacaatttgcaattacaggagaatgatgacgttcgcactgctgaaagccatccctgtaaattcctgcctaccaagtcacttctgtgcaagacagttcttgctctgctcttctgcagagcttcacagaaactatccttaccatataagattattcctaccctcttcatttctattcctctgctgcaacttcttttaatcacagtctgggttctggggagtagacttcggagttgagtttggcaggcagcatgtttattaagccatgccctggaaaaaaaaaaaaaaaaaaaaacacctgtagaagggcagaggtgacaggagtggaaagaggaagaactagagctgtgacgtagaccctatgacacgcttattcaaaccccatagacaacttgcagctaggatgacccctcagagttgtctcaaatggggttaaaatggctgagtgtttatactctgccccttcatcagtcaatagtagtgggttgccctagagagggtgtgacattggctggcaggactctgcaactcaggtggtacctgagagaactaacaactagaagctgcctgaccacagctggagcaacaagcccttccttgaaggtcaatcttggtggtgcacctccatgtccatcatgccttcttggcccagttaactcctagtcatttttaaaaatcactgctcaaagacatttcaacttttttccttttaaaaattgatttatagttgtatgcgcgcacacacacaaatacatctgtttaaattgagcctcctttagagacagtgagacctgaggacgggacagttttctgtttacaggctcacctttggggaccagctcaatgattttttgataactgccttttatgtaggaaaaggagacatgattatcatacattgccctttattatttttttttgtctgagcaacatttgcacctaagtagaagcaataacagcgaggctgaggctgataagctgaattagtgacataatgatgctataaaggagttttggattgaatactttgttgtcctttaacgttatgcacatagagggcagactggccaagcatttcacaaatgaatcacattcatcattggaggattgcttgattattgcaaatccattaccaccattaagccactatctgctgattccaaccgtaatttagcacaggacacaaaatacacctcctgcagtcactgtacataaaggttgagcaatttataattttagaatatgagacaaattacgtaattatttgacctgtattcactgagtaactgactaaataagtaggtcaagaaggaattaggaaaacttggataatccactcctaaataataggcttagttatcaagggattgtgacagatacatgcaaagatttcatatctccgaatcgttactgtgtttacaaagcatcatctcaaatcttttaaaagtatgttaaaatgagatttagtagtatatcctaaaatttgcatttactttttaataaaaagatgactaacattggagatgttaaaatatgcatttaccccaaaggcatttgttaacttctatatggatgaaaaaataaaattgtcatatttagaatgcacaataaatattcatcatctgatcaaatgttgatagtatatgaaccttaaccttcccagaaggaaagtgcttagtggtacagactgatcacttttacatagatgtcttcttccagcatctcataaggggcttatatttaaaaagcagtctttaataaataataattctttaataaaagatgtagacagttttttctatgaagcgtcactgcattcatgaaacttagaaaaaatgcttagaatggatttctgcatcagatgactcagaagaattaaacttgataatctgttgaataacatctgcacatgcacgaagcctatgagacaatcaaatacatggaaaccaagtaatgaaaatagaaccaaggctacatatgtacacctcttagggataaatatttccttcctttgttgttttttttctttattttaggtaggcaaacatttctgtcttcttttcagttcagccaataaatatagcttgcgttaaatgatggtatgaaatcaggggttttatctgaccatattttgtactttgatcttacactaaccttgcatgtaagatacacagaaatgaggcctagaagaggttaagcaacttgtccaattaccacaattaatagcaaaggcaaaatttgaacatatactttaaaaaacaattatctatagtattcctcctatccaaaaagcgcttttatatcttaagtccttggttaacaataagtctaatgttttatacactgtcttctctagcttgttcattgaaagctagaaggtgagcaattctataaacagtaaatgttgggtctaatatggcagaatccaggagtaatagtgaacacattcagtaaatggtatggcatagataccaatgaatcagaatagactcctagcctttgagaatagacttaacttctggtagaatctattatgtctcattactaattggccctaaaatttctatttatcactgaagatcaaggacattcatatttaagtttgcatggttcttgctcaaggaatgcattttcttatgaaaatttatttccacatgtaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggtaagaagattactgagacattaaataacttgtaaaagtggtgatttagactctgatgacatatttttccccagtatggttccagatcatgtcctactttacaacatgttatgtacattgaccacattgatctaacgttccattggaatgaactaattaagaatattttccagtgttctatgggatacatataattcagttgttgaaacattaacattagcggagcgtgaaagtggttatagtggagggggagagtatcaatatgtttgacactgggaatcccagtaaatccaggttgtattctaactttgccgagaatggtgttggtctttttatacagataatgtgtttgtataagcctaaactatacaggtaaaaatgatactagatctcatgtgagtagttgtagttaaattaattaccatcatcagatacgtagtgtggagaaagaaacatctgtcttatcagatacacactttgatatcaaacaccataaagccctgtatactttgttctagttcagggtcataagatgctcagagcatttttagtaaccaagacaaagagcagaacacaattaattatatgacacaatgttttgaataccaacagaaacaattgcactggaacagcaaatcaattgctataaagcaagagagagatcttttgtggattttaataaaaagaattcactgtaatacagtgaaccaaagtccttaactatattccattcaacattatatttcttaagatgaaaaagattttttttgcttttcttgtgtaaagttcagtaaatgaattaataacagttcaagaaaaagcaaagcagtgtaggaaatacatatgtatatgtacacatacacttagagatacaatatatactatatgccatatatactacaccatttatactctatatatgtatatatatgtgtgtgtgtgtgtgtatatatatatatatatatatatatatgcttgtgtgtgtgtatttgagagagagggactacagtcactttattttggtcttcctgttacccgtttcatttacccaacccagggctaaatgcattgcctaattaactgtttaaaatgtcactggactgcatcttgcctaattttcagtgcaagttatgttttctcactttgatttttttttttttttgaccactctaccattttcctatgccaatcctgcttctagaaaagctaagaatattaattttctctaaggtaaagctcagtccaagagcaaacacatttcaaataagcatctttgtcaggtgtcttgctccagctggatttaattaaccccatcccgactgggtttccaggtgaattactcagcaacctgatttagaacagaggcagacatgcattcaaatgtcacgttaagcagcgttaacacattgtttctcgtatgacagaagaaaatgtttccacagcctcaatacagttagatgagaagggatagagacattctgtctgtgttttaagtcaatgctcatttatgcagccacatgcttaacactaagggcccgaaaatattgattttgctgttcatgtacacatttgcagatgaataaaaatatcaaggatcaggttatgtggtccttgttggctctctaacgtttttcccttcaagtggaagacttcaatcctgcaagcatgttcccactctatatttgttaatattctatttaatgatttctgaatacatttgtaggtaatacagtaaacatacccaaattgccctgttttatctgtccctgacccactctttctctgtcaaaatatcctcatttatatactctctcctgtcatattggatgaatcatcagtaactctctttatgtattacatggttacttttcaagaggttcttcacagttgtttaatgttctttcatgaatcatctcccccttctttttgtatttggcagatgttcatattctttatctaaagaaaaaaatggttgaactctctgttccatagcgattgtcgttggcacaattaggaatgtcatgaggtgccctcatttcaataattgagtggttcaactatacagaacaaagacatgtagttaatatagagcataaggattgactaagtgtcatggcagttaaaagttgtgtgataaaacgcaaagtccactacaatacccttcaaaggaagccagatttctactttttgtgttaaaacccaatgataattgcttagaaatatgtacaaaagatgcagataaaattacaataactataaagttacaattgtcttcctaaatccttattttagtgtattaccacagcaaattagaagcaaatgaacactagaatcaggagcaaagggaaaacagaaacacaatgtgtcttcatgaccccaatcttaacttaccttatttcaattcttagatgcagtcactgtcagctacttgtactttggttcctgctggttataataatatgtgtgataatgtttctacttgttgacaaactaatttctaacagtataggtatttactccatagtatgaaaaccagccatattatgtttcatccccaggtatttcctaattttattacttataatcattttatagttgtaatttttgcttttattacattaaatggtatgagtatacctcattttaaatttttaccaagtttagaaaggaacttttgaccaatatgaaaaacgagaaaatcatcacacattcttactctcgcctcttctccacctcccatttcggattacattctgtttgcatcagtagtatttgtaacatttatatcagttctgtaaagataggtgtttttggcttgagtctgtaaattgaaaatacatcactcttcttatataaatgtaattaacattacagcaaaataatagaaacgaatgtttttaaacaattattattttgtagacaccgttctaggtaaaatattcaatcaagttccatgacgtagatgctgtcattttacccatctcacaaatagataaattgagtcatagagaggttacgtaatttacctaaaactgtttggctaacatgtggtagagctaggatttaaatttacactatcctaatcatggtgttgatttaattaaaaatctggtgatccttggttgcaagtcaataaattatggtccaggttaacattaaatgctgtgtgggtttccttcatagttggttagttttacaatttttatgcatttgaaagtcatagatatttaaaatgttaattaattttaatagtataaaagaattcaattcatttttaatgctagacgtgacctcaaaggccttttggttcaatgctttttgaatgagaatgccaaagctcaaataaattatatgacttagataagatatccacacactcagttggttagttagtggccaaggaaatggggaaggtaagacaagggaatacagcacgaatgcataagcaatgctcttttttctcatcatactcaatttaaccttgtatactatgccatagatgagaaaactagtttctcatatgttcccacctatgtcctttttttactcccattgcctacagaaaaaaatgaagataaggcagagtgcgcatagtgaacttaaaagtcccctaaatattctacaatttttaaatttttttatatatttttcataacaaaggcattatccaatttgtaaataagctagtttccataagcttgttagctgttaggggtattggaaaatatggagggattcgatttcctaataattgtaaaaattctggtgtattaactagagtagaagcaattaagaagaaaccaataaacctatacctttatttatgtatttttttgagacggagtctcgctctgttgcacaggctagagcgcagtgggccaaccttggctcactgcaacctccacttcccaggttcaagcgattctactgcctcagcctcctgagtagctgggactataggcacgagccaccatgccctgctaatttttgtatttttagtagtgtcggggttttaccatgttgtccaggctggtctcgaaatcctggcctcaggtgattgacccgtctcggcctcccaaagtgctgggagtataggcgggagccactgcgcctggccaattttgaattacagttttagaaaaataacagctaaactacctttgtaactttttttttgtttttttcgttattttgtttttttgtttttgcatagcatgagctcttaaacaggagtccattaatagattcaaatattctaaaactgtatgtagactctgttcacagatatggagagtttttttgtaggagtagaagtttcatagctctcaacagattctcaaaggtgtctgtgattcagaataggtgaagaaccacttgactaatgacttccagtgctgttgggataaattataatacgttaacagccaacaccttatgcaaactcagccagtttctttcttttaaacctatctcccaccacttgatacttagaatcttccaatggagccaggcctgtgaggtcttgattatctgagcatgttttgcttttttccttccctaagaactttaattctctaacgctcacacaacttagaattctattatcaatacattttttttaatgcaagtcgaaacgtctatttaatctgtctttcagcctcagaaaactttcttgaccgcttcagattttacaaaacattttcttattgtctgtgttttttcacatttagagtttaattaattcatatggcttcttcatttttcttgctcattaaatttaaaatccttataagacaagaactgcctcttacactcctttgcattttctctattatcaagtaacatggtatgtaagtttcatgtgctcatccattctctcgtgtagttgataaatatttgttgagcctttattttgtgtcaggctaggtttccagcagtgaacaaaataggcaataaaagattgtacattctagtggaagagaaagatacacagagaaatttaattaaattatataatacgttaaatagtaagtgttaatgagaatagtataaagcagataaggagaaagaaaataagtatatgtgagtttgatttgaggcatgcagttttctttcatttatctatttaggagactggttcttcctcagtcacccaggctggagtgcagtggtacaatcatggctcactatagccacccaggctcaagtgattctccaacctcagcctcctgagtagctgggaccacaggggcatgccagcacacttggctattttttttttttttttttaataagttgtagagaccaggtctcactatgtggttcaggttggtctctaactcctggcctcaagcaaatccttcagcctcagcctcccaaagtgcttggtttacaggtgtgagccaaggtgcctggccagcatgcaattttagatagggcttgggcagggaagaacttatcagtgatgtgattttcgagtaaagacccaatggaagtaaaggagtgagccatgtttatgtcttcgaaaagcgaattccaaatccaagtgcaggaaactatggatcctgtttatggaatatgaggaaagagacaagaaataaaatcagagagttaatagggacctggaccctgttggacttcgtagatcacatgaaatacgtaatttgtacttcccctaaagcagagatttgagaagacggatatgatgaaacatgttaacagatcactctggcaactctgctatgcactaattaacgcaggcaagagtgagagaagagttatgaggctattgtgataattcatgcaagataaaatggattttggactagagtgatggcagtgaggatagtcagaagcagtcaaattctgaatacattttgaattaaatgttgtgtgagagtaaaatagtcattaaggatgactccaagggtttttatctgagcaactgcaattttaaacacattgttcattattgaggaagggagaacagcaagaaaagtaggtaggtttgggggagtatgatgaggataaacatcagaagctcagttcaggacacttgaagcttgtgattactaaatggagataatgagtgtttagaagaatctataatttgaagtttagggaagaggtctgggttagacatataaaactgggcattaccagtaaatggctggtattgaaatccacgagactggatgagatagataaatttttgttgcttggataagctagcgtagattatttgtcatcttcaggattttcttttttccccacatctttattgctgtataattgacaaataaacgttgtatgtatttaaggtatacatcctcagcattcttttttgatacagggtctcactctgttgcccaggctagagtacagtggcacgattatggttcactgaaccctcaacctccctgggctcaggtgatcctcccacctcagccttctgagtagttggaactgtaggcatgtgacaccacacccagctagtttttctttctttctttctttctttctttttttttttttttttttttttttttggtagaaacaaggtttcaccaaattgtctaggctggtcttgaacttctgggctcaaaggatctgcccacctccgtctcccaaattgttgagattacaggcatgagccaccacacccaatgagatcttccattaaaattattacttgtttaaatagaaatattttaaagggtaaatgaattacactcaagacttaaggactatgggcattggttgtcaatgaaaattaagcatggaagtaaatctcatggaacattctagattgatttatatttgtctttgtgtatgtgtgtatgtgtatgtgttttaggccagacctatttgactggaatagtgtggtttgccagcagtcagccacacaacgactggaacatgcattcaacatcgccagatatcaattaggcatagagaaactactcgatcctgaaggttggtaaatttctggactaccactgcttttagtatggtagagtttaatgttttcatctgagacttgtcatttctacacaaaatacaaaactacatatcttaagttttccaatactgtagatatatttaaaatgttcagccttcttgcactatattatgaattgtcttatttaattctagttctcaaaataccagtatctaaaattgcagtgaagacttttaggaaaaaagcctttaaaatgtgtatgccctatggatggagcatactgcatttggagtgcattgactccaaataattataaaaagttaatgttttgcttatgctaccaagagatttgatagagtaatcagctataattaattagctactcttgccaatttcattcatatactctataaaaggcaacatggtttactatttaaatcaggaaatctattcctgccactacttctgttgtaatttttcactctggggagatcctctgttggatggttactcattttctgcttctttagttgataggcagaagtgtatttatatttttattacattacacttcaataactttgactcttatctctggtgctacatagtcataccttccagacgtagagattacagagataataacactgtgacctctactcttcttctagcctatgaagtacactttttgccatgccaattttgaaatggtagcctctgttctcaattctcaaggctttactacactctaaaatcaggagttggaaaagtgaaatcggtgggattgaagatgatatttgggtagaagctgttctacaatagaagctgataattaaatgcttttgggaatattaaatcgatttcatcaattccaaaacaggagatctttcaatatggatggtaggtcccatcaagaaaactcaaaaatgacccagaagacagccttttgccagtgaatttattatcaaccagaatctagtactcagttttgcagacgcagaagcctgattgcctcagatcatctagcagatccacattggggtgggaggagttaactttaagtttaaaaagtgatatataaataaaaatggaaattcagtaatcttaaatgagatataacaagcagcagaatattcacatacaattgacaaatatattgctcttgataagcacatgtacttgggaaagcaaattacaacaaaaatgttagtttgtgaagttgggatcagattaagttgacttgaaatgtttcttctcctttggataatgcatggctgaacactgaatactgtaacccctttttattgcttctatacacgatagtatccctcctacccctgtttttagctctaagggagaaactattaatcctacgtccttagtttgcagtataggggaggattactttactattgactcgtagtacacatttgtatgttttctcttagttcagtgaggtagaaagggcagacataatgaaaatacggacttcaacctctgaggataaagagctatactgtatgaatttgaaagataaggctgttaatatgtttgttttttattgaatcacatatggtcagttcccattattggggtgtatgctctagttattcttgtgtgtgtcctatcctttcataaaacagtaagagaagatttaaaaatagatatttttcttattaagtgacaaaatggcttttgacctctagtgctcctttgaacttacagaataggagtgcctaaatgggcatccacatcataatcagaaaataggtaaatatatacacctatgtatatatccacaaaaaatttaaatgaataaaaacaattttaaaaagtaggttgacgagcctgtaatcagaaaaaggcaggtacatgaatagtgtattttatagctaaaagagcctggtatacctaactccatatgctctcctaagtgggaagtatatgtagaaaggtacattgtatatcctataagatcaccattttactgtctcaaacttcaacaatttaaaatcaacaaaatgtaatatgaaatacaggctgattaatgaagatccagccactgcttatggtctcgttttcccaataaaatctcatatctgtaaagcctttctatatatagactcttccaattgaaagagcatcttatcgcttaaacaggtttcctgtttatttgcgtagaggtgtttgtagtattctctgatggtagtttgtatttctgtgggatcagtggtgatatcccctttatcattttttattgtgtctatttgattcttctctatttttctttattagtctatctagcagtctattttgttaatctcttcaaaaaaaaacacctcctggatttgttgatgtttttttttttttttttttttttttttaaatgtttccgtctccttcagttctgctctgatcttagttatttcttgtcttctgctagcttttgatttgcttgctctggcttctctagttctttcagttgtgatgttagggtgttgattttagatctttcccgctttctcctgtgggcatttagtgctgtaaatttccctctcaacactgctttagctgtgtcccagagattctggcacattgtatctttgttctcattggtttcaaagaacttctttatttctgtcagaattctgttatttacccagtagttattcagaagcagattgttagtttccatgtagttgtatggttttgagtgagtttcttaatcctgagttctaatttgtttgcactgtggtctgagaggttggttgttatgattttcattcttttgcatttgctgaggagtgttttacttctaattatgtgatcaattttagaataagtatgatgtggtgctgagaagaatgtatattctgttgatttggggtggagagttctgtagatgtctgtgaggtccacttggtccagagctgagttcaagtactgaacatccttgttaattttctgtctcgttgatctaatgttggcagtggggtgttaaagtctcccactattattgtttgggagtctgtctctatgtaggtctctaagaacttgctttatgaatctgggtgctcctgtattgggtgcatatatatttaggatagttaggacttcttattgcattgatccctttaccattatgtaatgcccttctttgtctttttttgttttttttaaatctttgttagtttaaagtctattttatcagagaatagaattgcaacccctgcttttattttttttgctttccatttgcttggtaaatattcctctatccttttattttgagcctatgtgtgtctttgcacgtgagattgctctcctgactacagcacaccatttggtcttgactcttcatccaatttgccagtctgtgtcttttaattggggcatttagcccatttacatttaaggttaatattgttatgtgtaaatttgatcctgtcattatgatgctagctggttattttgcttgttagttgatgcagtttcttcatggtgtcgatggtgtttacaatttggtatgcttctgcagtggctggtactggtttgtccttgccatatttagtgcttcctgaaggagctcttgtaagacaggcctggtggtgacaaaatctctcagcatttgctcgtctttaaagcattctatttctccttcgcttatgaagcttagtttgactggctatgaaattctgagttaaaaattattttaagaatgttgaatattggcccctactctcttctggcttgtagggtttctgcagaaagatctgctgttagtctgatgggcttccctttgtgggtaagccgacctttctctttgactgtcctgaacattttttccttcatttcaaccttggtgaatctgacaattatgtgtcttggggttgctctttttgaggagtatttttgtggatgttctctgtatttcctaaatttgaatggtgggctgtcttgctagtttgggaaagttcgccgggataatatcctgaagaatgttttcccaggtatactaatcaaacttaggttttgtcttttcacatagtcccatatttcgtggaggctttgttcattccttttcattcttttttctctaatcttgtcttcacactttatttcattaagttgatcttcaatctctgatatcttttcttctgctggatcgattgagctattgatacttgtgtatgcttcatgaagttgttgtgctgtgtttttcagttccatcaggtcatttattgttttgcctaaactggttattgtagttagcaactcctctaaccttttttcaaggttcttagcttccttccattgggttagaacatgctcctttagcttggaggagtttattacccaccttctgaagcctacttatgtcaattcgtcatactcattctccatccagttttgttctcttgtttggtgaggagttgtgatcctttggaggagaagaggtgttctgggttttggaattttcaccctttttgtgctggtttttcctcatctttgtggatttatctacctttgatctttgacattggtgaccttcagatggggtttctgagtggatgtcctttttgttgatgctattcctttctgttttagttttccttcaaacaggcccctctgctgcaggtttgctggagtttactggaggtccactctagaccctatttgcctgggtatcaccagcagagactgcagaacagcaaagattgctgcctgttccatcctctggaagcttcgtcccagaggggcacccaccagttgccagccagagctctcctgtatgatgtgtctgtcgacccctgctgggaggcatctcctaggcaggaggcacgggggtcagggccccacttgagaaggcaatctgtcccttagcagagctccagtgctgtgctgggagatctgctgctctcttcagagccggcaggcaagaacgtttagtctgctgatgctgcacccacagctgccccttccctcacgtgctctgtctcagggagatgggagttttatctgtaagccgctgactggggctgctgcctttctttcagagatgccctgcccagagaggaagaatctagagaggcagtctggctacagtggctttgctgagctacagtgggctctgcccagtttgaacttcccagcgactttgtttacactgtgagggaaaaccgcctactcaagcctcagtaatggcggacgcccctccctccaccaagctggagcctcaggtccacttcagactgctgtgctggcagcgagaattacaagccagtggatctcagcttgctgggctccgtgggcgttggatctgctgaacttgaccacttggctccctggtttcagccccctttccaggggagtgaacggttctgtctcgctggcgttccaggcaccactgggtattagactcccacacaataatagtgggagacttgaacacaccccactgtcaatattagacagatcaacgagacagaaaattaaaaaggatattcagtacttgagctcagctctggaccaagcagacctaatagacatctacagaactctccaccccaaatcaacagaatatacattcttctcagcaccacattgcacttattctaaaattgacgacataattggaagtaaaatactcctcagcaaatgcaaaagaatgaaaatcataacagcctctcagatcacagtgcaatctaattagaatgcgggattaagaaactcaaaagtgcacaactacatggaagctgaacaaacctgctcctgggtgactactgggtaaataatgaaattaaggcagaaataaataagttctttgaaaccaatgagaacaaacacacaatgtagcagaatctgtgggacacagctaaagaagtgtttagaagagggaaatttatagcactaaatgcccacaggagaaagtgggaaagatctataatcgacatcctaacatcacaattaaatgaactagagcagcaagagcaaacaaattcaaaagctatcagaagacaaataactaagagcagaactgaaggagatagagacacgaaaaacccttaaaaaaaaaaaactcaattcaggagctgtttttttgaaaagattaacaaaatagatggctagccagactaaaaaagaagaaaagagagaagaatcaaatagacacagtaaaaaatgataaaggggatatcaccactgatcccacagaaatacaaactaccatcagagaatactataaacatctccacgcaaataaactagaaaatctagaagaaatggaaaaattcctgtacatatacactcttccaagattaaaccaggaagaagtcaaatccctgaatagaacaataacaagttctgaaattgaggcagtaattaatagcctacaaaccaaaaaaagcccaggaccagacagattcacagccgaattctaccagaggtacaaagaggagctagtaccattccttctgaaactattccaaacaatagaaaaataaggactcctccctaactcattttatgaggccaacatcatcctgataccaaaacctggcagagacacaataaaaaaaatttcaggtcaatatccctgatgaacatcaatgtgaaaggctcaataaaatactggcaaaccgaatccagcagcacatcaaaaaggttatccaccatgatcaagttggcttcatccctgggatgcaagattagtttaacatacagaaaccaacaaacgtaatccatcacataaacagaaccaatgacaaaaaccacatgattatctcaatagatgcagaaaaggcctttgataaaattcactacccttcatgctaaaaattttcaataaactaggtattgatggaatgtgtctcaaaataagagctatttatgacatacccacagccaatatcatactgaatgggcaaaagctggaagcactccctttaaaaactggcacaagacaaaaattccctctctcatcactcctattcaacatagtattggaagttctggccagcacaatcaggcaggagaaagaaagggtattcaaattctctgtttgcagatgacatgattgtatatttagaaaaccccatcatctcagccgaaaatctccttaagctgataggcagtgtcaacaaagtctcaggatacaaaatcgatgtggaaaaataacaagcattcctatacaccgataataaacagccaaatcatgagtgaactcccatttacaattgctacaaggagaatagaattcctagcaatccaacttataagggatgtgaaggacctcttcaaggagaactacaaaccactgctcaaggaagtaagagaggacgcaaacaaatgaaaaaacattccatgcttatggataggaagaatcaatatcatgaaaatggccatactgcccgaagtaatttatagattcaatgttacctcattaagctacaattcactttcttcacagaattagaaaaaaactactttaaatttcatgtggaactaaaaaagagcctgcattgccaaaaccatcctaagcaaaaataacaaagctggaggcatcatgctaccttacttgaaactacactacaaggctacagtaaccaaaacagcatgatactggtaccagaacagatacatagacgaatggaacagaacagaggcctcagaaataacaccacacatctacaaccatctgatctttgacaaacctgccaaaaacaagcaatggggaaagcattccctatttaataaatgatgatgggaaaactggctagccatatgcagaagactgaaactggaccccttccttaccccttatacaaaaattaactcaagatggattaaagacttaaatgtaatacctaaaaccataaaaaccctagaagaaaacctaggcaatacctttcaggacataggcatgggcaaagacttcatgactgaaacaccaaaagcaatggcaagaaaagccaaaattgacaaatgagatcttactaaatagctcctgcacagcaaaagaaaactatcatcagagtgaacaggcagcctataggatgggagaaaatttttgcaatctatctatctgacaaagggctaatatccagaatctacaagaaacaaatttacaggaaaataaccccatcaaaaagtaggcaaagggtatgaacagacccttctcaaagaagacatttatgtggccaacaagtatgtgaaaaaaaagttcatcatcactggtcattagagaaatgaaaatcaaaaccacaatgagataccatctcatgctagttagaatggtgatcatcaaaaagtcaggaaacaacagatgctggagagaatatggagaaataggaatgattttacactgttgggagtgtaaattagttcaaacattgtggaagacagtgtggtgattgctcaaggatctagagccagaaataccatttgaccaagcaatcccatcactgggtatatacccaaaggattataaattattctgtgcttatttcagcactattcacaatagcaaagacttgaaaccaacccaaatgcccatcaatgatagactggataaagaaaatttggcacatatacaccatggaatactatgcagcaacaaaaaaggatgagtttcatgtcctttgcagggatgtggatgaagctggaaaacatcattctcagcaaactaacataggaacagaaaatcaaactcggcatgttctcactcataaatcggagttgaacaaccagaagacatggatgcagtggagcatcacacactggggccttttggggtgtgtggggctaggggagtgatagcattaggggaaatacctaacatagatgacggattggtacagcaaaccaccatggcatgtgtatacctatgtaacaaacctgcacgttctgcacatgtatcccaaaacttaaagtataataataaaaagtttcttaaagtttacttatggctgcaaataagatgaggattcagcataagtcatatatttttaaaatatgtcaattcttgccattgtgttagggaaaccaccaagtacacatttatacatttttgctcagcatttttcaggagataatctcaatgatgattcaaagaaaaaaataataactcataagaatttttatttactgactgcttagtcacaaaagacagaacaccatctcttgaagtctcagacttagaacactctcttcgatagatttaccagcaaaattcgtgattcatgcctgtatagtaattgcttttgtgatgttcatatttttatttaaccagatattggttctgtagcttatgcatgatgttggctactctccaaagaaatttcattttaaattagttatgccccttaggagaataatgaaacatttggggagaattttattattgggggattgaagctatatttggtttaagaaatacctgccaaataatgctttgacaattttaaacataagctttgttgatagaattgctttataaaattaggaagtcattgaaaccttgtaggatttcatatatagaatttgatatgctttggccttaactggtgttttgaggcctgaggtttagttttaagtggaattgccttttaaaatgagtagcagtaggcattagcataagcgatttcaggagctgtttctagtgtgtttagatgctaacatatgcaaaaataagtacatctagggtaaacttaataaattatgtatgtttatgctcatagataataggtatatctctttaaaaatatccttttgtgaatcagacaattctcttcccgttatgatttctctgtaagacagtacattctacatgcgttggtcgtgggtttcatatacattgtttctctgagtttcaaacagattggtttgtttgccagtccaaaaaaaaaaaaaaaatcctccctatattaagagagtgctttgtcagctttcccctgtgaataacaaagtgaggatgttctctttaaaggaataaaacaaaaaatcagggataaaagattgcgcctgttctagatgtcttttgaatattagtgtagaaagccatttccatttaggatatgaaatatgatatggaaatgttcttacttatttaccagggtaactttagaacaaaaatgaataatgacagtcaaatttgaccaaaaaaggaaggacactaggactcgagagaaatttttgtatcctcaaaatgacatttacaaacccgttagggtttggttttaatcccctttattttgacttcctgagaatggtgacacggattctattttctgcttggctaatccctgcatcactcttgagttgtttttatagccttcttttccaagaattagctctgcctgttggaaagttttactcctggagtgaatgctttcagacttggctttgtatgcatgcaggattttaacctacaaaaataatcatggaaagatacatagaatttgctataaaagagaagaatatttttaaggcctcttatgttgggtttgatatcaattggctgaacaagggctgttttaacttttttccgcctctgctgtaatcatcacattttgataccataatggcaagaaatgtttataagtttacacaggttaaaattgagagggttaattctcaggaggattagagttaatttaaataaataaatatttttgtgaacataaacactaattttatatcatttagattgatttttgtctagaactcattatagagtaccttgttttcagaaaatctaatgcgattgcaatattataggtgttccttctctatatacggtatttcaactagaaatccttactgtaaatatttcagacaatttagagtcaaactctgcagttgaaaatatatttaagaaaatatttaagaaaatatttcactggcacttacatgaatgaaaaatggccattgcctttttgatgacaaagtaatatataccaaataggtatgatacagatgattatattaacattcagatattattgtagcaatttcctcttccctgatgggaaatcttgaaattgctcttcatgacaaaaattaagacgtaaatgttatttcccagtggcctaaaagttagaagaggcatgagagtattccagtgtgttctcttgatgttatgtgttgtacatctttctcagttcagataccataaaaaaactgagtattttctgggcagttggaaccagtcactaataaatgaaagcaatttttgttctccttatccatttcagttgtttggatgacaaataattgcatgtaactgtcccaaattcacctacttagacaacagagacttgaaaaacattaaatatgatatttgtgtgtgcgggagcctggcttgaatttaccctttataacaaattttggtattttctactaatctttcacattcttctatgatttgtcaccattttaactttatggaaaatggtcaatttataatttctatctcccctaggggctgatttgttaaagtatgctttagttaagtaagagtttcttactcagttggggaatttaaataatgaagtataatcatgcgattgaagatgtgcattatggattaggttctatgccaaatttgttcagaaacatttaaatataattcttacctagataactgagaatctcttttcaattagcttaccaggattattttcacaactttttttttttaattacaggtgaaataacaatatccttggcctatacagtgacattaagtgatttttgaatgattgacaagacattaataaattaataatgagaaatgcagccatgaggttctaatgctaaataatatgtaatagacactttgtggatggttttcctagtcatatcatcacaatgagttcatgagactaaagaaatatattaaaaacatctattggtatttgttaattttatttcagctatgaaggaatacatgagatattaggtttgattcagaaaagtgttctatagttgatatctgtgtttcttgtcacagaattttgccttggcaaaaacattttgaccattctaatgatggtaaatgagaataaaatggcataagtagtttaaaattttctatgtggttttaagtcagtgataatatttgaatgtaatgtatattttgctgatagttggaaaacttacttcactgtcttcaaaatggagttaactgtgttttatacataattataagtgatatcacagggctgggtgtgatggctgacacctgtaatcccagcacattgggaggccaaggcaggagaattgctttaggccaggagttcaaggctgcggtgagctatgattgtgccactactctcaagcctaggcaaaagaactgaggccctgtccccccatcccacaaaaacaaacaaaaaaagacatcacagaacctgcaaatgaatatccaaaaaccttaaagctgggcactggaaaaatagatattaggttggtacatatgttttccaattaaataatttctatatataaaatgcatgtgacattttacagctggaacatgaaatataagatgaaaatatactattttacaacaatatttgggtaaaataatgatgaactaaagtctttgttgatgtcatttaaatcttataagagggaaatttaattgtcatacaataggatttattccttgcagagggaaacctgaagatttatagttgtcttgtcattttattttaaagcaataagctatcctcttagatttattctctttttagaacttttatttttattgatgcataacgttttacatatatgtacatacatgtgatattttgttaaacgcactgaatgtgtaatggtcaagtcagtgtatttggggtattcattactttgagtatttatcatttttatgttctgtgaacattttgagttctctcatctactttgaaatgtacatcatattgttgctaactctagtcacccctttctgctgttgaacattagaatatataccttccaactatatatttgtacccattaaataacccctttttatattcccttcctacccttcctagcctctggtatcttattatactctctatttccatgagaacaactttttttacacctatatatgagtaagaaaatgtaaaatctatttatctttgcctcgattgtctcacttaataacctgcagtttcattcatgttggtgcagaaaatgtaattcttttttatggatgaagagtattccactgtatatatgtaccacattttctttatccatttgttcactaatggacacttaagttgctattataaatagtgcctcaataagcatgcaagtacaggtatgccatgcatatacttttcctgatagttagaaaagtatatgattgctttccctttacatatatacttattagtggcattgctgacacatactctatttctatgtttagttttttgagaaatcttctccatactgttttcaatagtggctatactgacttatattctgaactacaacaatgtattaagagttcccttttcgttgcacctcgtcaacatctgttgttttcttgtctttttaataatagccattctaactggggcaagatgatggctcatcatgacttgatttgcatttccctaatgattagtgatgttgagcattttttcatatacccgttggtcatttgtcttcttttgagaaatacttattattgtcctttgtccatttttaatgtgattatttttttactgttaaattgtttgggatcctcgtatttcctagatattagtctcttgtctgaatagtttacaaatcttttctcccattcagcaggttgtctcttcactctgttgaatccttcctttgttttacagaagctctttcattttctacagtcccaattatctatttatgtttttgttgcctgcgcttttgaggtcataaccataaaatctttgcctagaccaaggtcctgtctgttttccctatgtttgcttcatgtagtttcagttttaggtcttacctttaaatccttaatccatcttgagctgaattttctaatatggtgagagacagggatccagtttcatacttctgcatctgacaatccaattctcagcaccatttgaagaaggtgtccttccccctaatgcatgttcttggtgcttttgtcaaaaacaagttgtatgtaaatacatggatttaattctgagttctctaatctattccattgttctatatgtctgtttttattctaacaccttgctgttttgtcaagtagtgtgattcataagtctttgttctttttgctcaggattgctttggctattcaggctctctgctggtctttgatcgtacaaattttatgatcactttttattccatttctgtattctgatagggactgcattattcaatgtagaatgctttgagtagaaagatcatgttaataacattaattcttctgaccgataaacatgggatgactttccatttgttggtgtactcttcaatttgttttgtcagtgttctgtattttatacggacctttccctcctgggctaaacttactcctaggtattatttccagccgttgtaaataggtttgccttcttgatttctttctcagccagttcattattggtatatagaaatgctactgaattgtgtatgttgatttttgtatcctgcaactttactaaatttatttatcagatctgagagctttctggtgagggtttagctttttctagctataagttattaacaaagagcagtacttggacaacgatttcttctattaggacgccttgtatttctttctcttgattgctctggctaggacctccagtactatgttgaatgagtggtgaaagtgggcatccttgtcttgttcttttttttgtttttggttttttgtttttgagatggagtcttgctctgttgcccaggctggagtacagtggcccaatcttggctcattgcaagctcagcctccagggttcatgccgttctcttgcctcagcctcccgagcagctgggaccacaggcatctgccaccatgcccggctaattttttgtatttttagtagagatggggtttcaccgtgttagccaggatgatctcgatctcctgatctattgatccacccacctctgcctcccaaagtgctgggattacaggcgtgagccaccacgcctgaccattccagttttatagggagaaatttttcagcttttccccattcagtttgatactacttgtagatttgtcatatatggtctttattttgttaattttttttgtatgcctagtttgttggagtttttatctcgaagggatgttaaattttatgaaatgttcttttgtgtctattgaaaggatcatgttttctgtttttcattctgtttgatgtaatatgtcatatttattgatttgtgtatgatgtatccttgtatcattgggataaattccacttgataatattacattttttatgttctattggattgctagcattttgtagagaatttctacatcagtgttcatcagggatgttgtcctgtattttttgttgcataattgtctgggtttggcatcagggtaatgctggcttcatagaatgagatagggggaattccttcctcttcaatttttcttggaacacttacaggagaattggtaaagtttggtagaattcagcagtaaagacatctggtcctggactgtcttcgttgggaaattttttaagattactgattcaagatcattactaattatagatctgttcagattttctatttcttcttgatccacggttggttgtatgtgtccgggaatttatacattcctctagatttttagtttattatttaatagttgttcagtatagtctctgaactttttatttctatggtatcagttgtaatgtctccgtcttcatttatgattttgagtcttttttttttcttggttagtctagcaagtgctttattttcatctttttaaaaatcaaacttctcatttcattgatactttgtattttttgctctctattttcttgagttttgctcaatttttaggattttcatccttctactaattctgggtttggtttgtttttttttctttgactagctccttgaagtactttgttagattgtttgaaatatttcaacatttttgatgtgagcatttttgctatatacatcccccttagcactgcttttgccatatcccgtaggtgttattatattttgatattcatttgtttcaataattttttgaaaacatttcctcaattttcttccttgacccaatggtcattcaggagtatgttgttcaatttccatgtttttgtacaggttccaaagtttctctttttgttatttccttgtgttttaagaagatattagatatgattttgattttttataaatttgttaagacatattctgtcataacatatggtctgtcctggagaatgttctgtgtgcttatgagaaaaaaatgtgtatgactgttgaaggaattgtcctataagtgtctgttaggactatttggtctaaggagcagtttcaagccaatgtttctttgttaattttttgtctaagtgatctaatgctgagagtggggtgttgaagtcctcagatattactgtatttgcatctagctctccctttagatctaatacttgctttatatatctgggagctctcgtgttgggtgtatgtatgtttagaatttttatatactcttgctaaacttatccctttatcattatataatgaccttattgtttgtttttactgtttttgactgaaagtctgttttatgtaagcatagctgctgcttctcccctttggcttcggtttgcataaaatatacttttccatccctttacttcaaatctatatgtgtctttacaggtgaaatgagtttattttaggcagaatatttttgggttatatattttttaatccattcagccagtttatgtcttttatgtggaatgtttaatcaatttacattcaacattattactgatatgtgagggcttatttctttcattttattgatttatggttgttttgaatattttttcttcatttttttccctcattatcattatagtgtgatggtattctttagtggtaacatttgagtaacttttcttgattttttttgtgtgtttgcactactagttgtttttatatttttatgtgttttcatgatggtagttgtcattctttcacttccaggtataggactcccttaaacctttcttgtaaggccagtatcatggtgataaatttccacagctttcactcgtctaggaactattttatttctccttgatttatgaaggctaccttggctgggtagagtatccttggctggtggttgttttctttcagcaagtttaatataacatctcattcttctctggcctgtaaggtttcttctgagaaattcactgttaatctgatggaggtttctttataagtgacaaggtgcttttctcttgctgtttttagaattctctttttgtctttggcttttgagagtttggctataatgtgtcatggacaagacatttttgaattgtatccctttttgagatctttcagcatcctgtatctggatgtctaaatctcttgctagacttgggaagatttcatctattattttgttaaatagggtttctaaacctttagtttctcctttaccttctaggacataaaaaatgcaagcatttcatggctttatggtgttgtatatgtcacataggctttgctcatttttttaaaattttttgttattttttgtttgagtaggttattttaaaagacctgttttcatgttctgagattcttctgttttatctagtctcctcttgagtctttgcctttgattctgaatgtatatagtagtatacttcctgtatgatttctttggatgtaaacagtatgaatggtgtctgtaacttcctcagtagcttagggtgcagttgttagcagaagctgtggtgaagttttgccggtgactgggacaccaagtggtccagtcttcaggccccagtggtggcatcagttggttgagcgtgcctgtcctcaggcctcagagctgtgtacattggcattgatgttagtgtgtccaggcaggctaaccctttggcttataggtggcttgcttggttgtcaggaaaagcataggtgggctgggtgggtacacaggttcccagcccaggggcagcaagcatggtgcgggtaatggcaatagtgggaggggggcaaccctctggaatgcaagcaatccatgatggtgttggtggtggatgcaacagattgggcaagccagttcctaggcctgcagatggtgcatgtaggttgacgccagctttggtggtagtggaagcttgagtgggcccaaattcaggccccaggaagactagtcagatgccaatggtggtaaactggggtgggagagccccaggtctctatacaaatttttatgtactgggggatttggaagagcagagctgggaagacctgtcctcaggactcctggtggtgcatgcaaccactggttattgtagtcgaggggcaaggtgctccccaggtcccttgtgcaatgctcaggtggaaggcagtgttggctacactgtggccctgctactggagagggtaaggttgctttccttgggagcagccataagcagttgcctgggtagcctgtgcgtcgcttgtgtctcaactccacagcagttcacagtgacagcatttgcaggcagtggaattagtcttcagtgtgcatgaagttgagtggccacccctctgttgggcaggggagggtttgctgccagtggttcctgccttggccccagcagttgcagccatgggtgggaaatatcactgagactccaggaatgtggagatagggaagatttttagtcctaggtcaggacatagactggtgggggctgggctctcaaaaccaggccatgttgcagctgcttaggactctagagtttgtggaacccagcatgggcttcttccgtgaagcaatgcctttgcacagtatctagacagctgtgtgttggtttgggggcccacacgggttgaagggctctcaattggctaggattgtaggaatcttgtacaagaatgtgtacctttgtgcatctctaattctctccccatgttagggagcctctccagactcctagccaatctcagctggatagagtgcctcatttccttctttttccttttagtggttttcattgcttctctgttgaatttcagtgttttctcttagttaatgtattcaaagtatgattatctacttggtactttggttcctctccatggaagaggtgagtaacagatccatcaattcagccattttgaagccccagattttttgtcttatggcaatcgtgtggagttagtggatcatatgatatccagttgaaaagtgagaaaactgttacaactattaaattattaggaattttatatattattacaatttaataaggtggttgaaaccagtgtttttacttttaggaaatatcctgtaatatcattcttgtgagatgttaatattgctgaataaacttttgcttcaaatcaaagcacatttttcccctgcaaagatttttctaatttatcatcagtgatataaactcaaatttgcaagttccttttggtagaagagtgcaaatgtttaagtagggcagtcatgttctagataatttccatactttatcttatgtcttgtacacaacaattccaggtaagtttatccttcttttataaatggaaaaactgaggcttagagagctttattaaaatcaagatcacacagccaatagataactgagctataatcaaatccagggtttatctcttcttaaagtccgtgttatttctcacaagactgtccaataaaatcggttggggaagctttatggcaacactgggattgaaactagtattttatttcactgaggacgggctgtgacatcagcaatttttagaagctcagtaagtgagagtatcctgcagctaagatagaaacaactacaatggaacaattgtttctgtgagatatgcccttttataggataagatccagaatctgttgtcccagcatttgtttagacttctagcattttcttccttaaaaaatgactaagcctgctgttcacatcttcaattactggagtactgcttattgctaacagttctgttaatgagaaattgttcatccacagacaaagtaaaaatagactagctgtcacataagactggccatcaaaacattctctttaggattaagaaacttgccttatctcctgtctgcacagttgtctctcttcattccttcttctatttattgcttcacggacatgtttgtgatagaatggtactctgactcaaacagtttccagcaagggttgcccaggtgagaggagctgtttgcagaggtgatccctgactctttgttctttaatttatttcttcttttgcctgcctctctcatcttgttactaattgacatcactgtgttctgctatctgaggtttgttgatgccttttgcagccaataaaaatgtctttcattggcagagctgataaagaactagaagaatttttaataataactaagggctaataagggaaaacaattaaaatgatggtaaaataatagttttcaaattagaagtctgatcccataaatccacttgaaataagcaaatggcttaattttatgatctctgatattaatgccataaataggttgaatttatttaccatttatccagggttagttttgctaaacagtttgtattttagccagatatgcaacttttactgacaggacataatgaactttggagcctgcactgttagtgtagttgtaaggagataaaattggcaattatactcacagatggaatagaatttaatctatgacatttacttagctgtacagaaggatacaaggcaggagatacactgtcatagaatctttgtatcattggatggcccagaagcaaccaacatacagatttccacatgcctctcacccaaatgtgctccatatagctgctaggacaacggccaaaatcagtgtggtttacttgacatgaagaaattgcagcattaatttcccaccaatatttaataccattgttgtcacataggacaaaagactatatattgcctctctgccccactccccagttaatttaatagtagtcctacctagcaaacaagagtgacaagaaattctactattatcttaactcttaatcctaagaaaataagtttctatgttcattttcctaggcagcatcagattaacctagggttgatttaactttttctacacagagccaactagttttgggttaaaatctgatttttgcctttattagttttaggccactggaaaattattgaggctcagtattgctcacgtgtaaagtaaaaatatttacctcccactgctacttcaaggagtaagtaaaacctgtatgtatttggcccgtaatatgagcccagaaacagtagctaaagttatgtcaaataactggaatgttgtaaaaattaaatggtccctttatactcctgtagggaaaactgatctttccagttattttgcctgcctctagaataaatgctgactctccccaaattaaatacaggagtcctcccttattcattacagtttctgctacccatggtcaaccgtggtccttaaattgatgagtacagtacaattagatgatggtggggagggtgggcagggagaggtgagagtccacattcacgtaacttttattactgcatattgctataattgttctattagttattaatctttttctgtgcctaatttataagttaaattttatcataggtatgtatatgtatgggaaaaacagtatatatagggcctatttgtggtttcagacatctgctgtaggtcttggaacatatcccccgtggaaaagggggatctactgtcatttcccatttgaaatcttgctggtcttcctgtgaccttcccactcattctggttttctggtctgaggaatactgctggctcacagctggtgtactgggtggtaatctttgatatccttgagctccagagtctaatctagttttcataaaagatttatactatatcttaaattcctcagagtggttctctctctctttctctctctctctctctctctctctcacacacacacacacacacacacacacacacacacttgacagagagattgattcacagttgtcatggatacatggtagatttctagcaagtctcctgaaggctggttcatgatagtaccttataattgtcatagtatttgtaagacattagttagcacacttgcaaaagtataactaggttttctcttgtagtcattacgtcatatgacatcgtaaaagtggttgaattggttcccagactctcagaaaaactcaacttctgaagctgggagtaatacatacatagtaatattgatgtaatctggtgtgatatttattaaacattaagtgctgggcacattgcttgatattgtataatttcgttttatttctgcaaaaactctaggaggtagagactattattttggtcatttgcaactgaagagtttatgtaaattgcccacatcactcagctagtgagttggagttaagattccctacttgtaactactacagaatataatcttatggcagaatattcctctcttcttccatgaatattttctttgcattaactaaaaggttactcattttattacagggctaattgggtttgtttttaattggatgcacatccatcagttgattccaaatgttttgaaaataaatggaaaagttttataaactagagccagaataagagggatactgaattctttttactatgatgtttccttgagagaatcattaaataattaaagtagaaggatgtttacaaatcttgcaagtatgacattctatccaagccacactaaagttatcaaagggagacactcaccagttatgaaaatattcccctctactctttctcagttaactctaaaattagatggcaaaggcatcaaaacatctcactatctcaaatatttcctcagtgaggtcgtgatgtgaacatctcttatctagattgaaatcccaccttgagtcatatgtggattaaaaaaaaaagctattatctgagaaagtctaaataaaaagatacattttacctaggctttaatatctaagtttttctgtatagaatcagttgggcaagtgagtctcttggaaaagtgatttgaaaactgtttttattaataattggaatacacacacacacacacacacacacacacacacacactcttattcctcctcaagaggcaagagtacatggtgaagcccttaataaattcacctcactgtagttaaacagcagactatgatattgttgtagttgttaatcaaagggactctgaaaagagacagccagaagtggggaaaaaactagtatagaaaaataacgattgggcatttgagtatttggaaaaaacctggtgaagtaactaggttttaaaagactgaagagaaagacaaatttcacccattgcaaaatataacaacgatataaaaatgagacataagctcctggataaaaataaataatgtatttttttctctctattatatctcgaattttgctttcaccaacaaactgcatgtgaaatacgaaaaaagttaaaaaatatggaatattaagggactataagatgagaaatttttaaattgttataacctaagtaaaactgctaaagctagttgtagcgagatctgtcttacataaattttccattaaatgataatatctttgcattcatcataaacagaaatgtacattttaagcaaaatcattataatagaaatgataatactccttacctagccttcttcacgttaatcttaacatagactagtgaagaacatagcaaaggtagtgcttgaaggaatgttcttattgaaagaaatctttcctcagattgatcaagaggcattgaataatcataataattcaaactttaatcttgcagatggaatgaaaatgtttaaaattagaattattgtcagagcttaaatattgttacttacacaagccaaatacattaatattatgagcactattgttttagctaatgtgtcttttactctgcagagtacatatagactagtctaaaaggttttttttttttaatgcttttatagagcacgagcatttgtgcaggtggctgagtagactaagattttttccaatgggttgatttgaccacatcattaataaagtagaaattctggagcccctactttttattcttagtctgacattgtaaattctttcagatgctacataagcattttaaagttatgtgccccaggcttactttgttcagtagaaatgcatgttaattcatcaaatgtctattgataactttacataaggaatagtgctatatactccaagtgtgtcaggaagtaaaagatatacagtctgccaaggtattgaaaattgcatataggccaacaaacaatatataggtaactgttatataagacagaatgtgaactaattcagagaatattttttaaagtacagagcatgtttttcattctaataaatgtacaaatatttatgtcaaatgaaaatgtggctgcatcataattcttatatgggattttaaatataccaaaatccacggatccatacagtagttcttactctgcttccctaattttattagttggacataaatgcataaatcgataagatgattttggagcgggaacctaactttttctatagttccttggaagttaattgatttcttaagtgataaagtccaccactattttgagtaaggtttagttaatgatttctgtttaacatgtgtgatttctaataaaaagttctggatttattttctcttgttgaaagttgttcattagaactgacacctgagctaacataagcaaaagtcattgtaagtccacacgtttgcacagatgggtgtccccccaccatccttaggtttgagcaatggatttttacaagtgaaactcagtgcaattaatcacctccaacatgagaaaatgctctttaaactattttaagtcaacatttacaagagaaattggcctataatacacctcgggttcttaacctttttgagagctatagaaacgctgcttctctataaaggtaacatatattgccaataaaatacataagggaggacatctacttataaaactcagaaaacgatttaataggaacagttgttttattagccttctgctctttaatggctgagatcatcctggggctatttaaaaatgatttaatttgtcctctaaacacacagatgagttccaggtgtgtatttcccccccccacccccgctccatgaatcaaccatgtctgcactgacattaatagcttggatcgggaaatctctgtaataataaatctatcttttaagttggtcatttaagcagctttaagtatgaaaaaagtgaagtattagaactatttcaatccatgatgccttatagattatactttaagaatacgactgtgcctcactatctgagaactggttctaggaactccagatactaaaatctgtggatgcttaagttccttatataaatgatgtcatatttgcatataacctatgcacatcctcctgtttacattaaattatctctagattacttataatacctaatacaatataaatagtacgtaaatagttgttacattttattctttgtgtttaatttctaggttcagggttacacatgcatttttgttatatagataaattatgtgttacaggggctctgagtacagattactttgtcacccaggtaataagcatagtacccaacagggagatttctatcctgttaatttttattgtatttcctgaatatttttttatttgggaaacaatttattttttttggaaatttttgtgggtacatactaggggtgtgtgtgtatatatatggtatatatgtgtatatatatgtgtgtatatatataccatatatgtgtatatatatgtgtgtatatatataccatatatgtgtacatatatgtgtgtatatatggtgtatatataccatatatgtgtatatacgtatatacacatatgtgtatatacgtatacacgtatatacacatatgtgtatatgtatacatatatggtatatatgtgtgtatatgccatatatctatatatatggtatatatatatacatatatgtatatacatatggtgtgtgtgtatatatacaccatatatgtatatgtgtgtgtatatatacaccatatatgtatatgtgtgtgtatatatataaacacaccatatatgtatatatacgtgtgtgtgtatatatacacacaccatataggtatatatatgtgtgtgtgtatgtgtgtgtgtatataatttttgtgggtacatggggtgtttgtgtatatatgatatatatgtgtatatgtatatatatacgtgtgtgtgtatatatatatggtacgtgagatgttttgatagaggcatacaatatggaataagcacgtcatgagaatagcatgtcacctcaagcatttatcctttgagttataaactaattacactcttgaagttattttcaaatgcacaattattgactatattcaccctattgtatcaaatcagaggttatttgaatttgcagatacagaacccgcagatacggagggcccactgtatatcactaaatcattcatacctctccacctgtacaaccaccaccatagttcaagttattctcatctttttctgtgactgcaggaagaacttgacaatgactggccctattttctttctggatttaacttaattctcttttacacacaatcatctagcatgatatttacatagtttaaggccttagcacttgctgttccaactccctgggatgttgttcttccactctgcatttcacagctgaaccccagaaagattatgtcctttgttgatttaacccttctcagaatagcatgtgtctctgttactgcatacatattgaaactattcttagttttttgttttgttttgtgcttatgttatcacatactatacacaccaagtctgtaggctgtttttttgatattctagtgatttttaatgataatatttaatacatatatgagaaaagaacctttttaatgttaagggagagcatgatctgtgaaattatctgtctttaatttatctttggaaatgaacatttttcaaagttttcattagattgtattcaaaattggtttttattctaaaaaattaccatgttactatttcatatttaaatgcaactaggattagacaagcaacaataataatttttttcttacctgggagcctacatgaatactgagtgtattaagatatcaactgagatatcttgctatcttagtttgaggagaataccatatatttggggaaatagagagaaagtggagtgaacatgtaatttatgtctcttaaaggtgactcaaatgttctttatctgtatcttaaaatctttagtgagcattcttccttatgtttaggctagttttctctctgagataggtaaagtaagctactttgccttagtatgcggatgtatgtgtgtgcacgtactcatgtgcccatcttgtcaatacatggagagatggaataagacgaatgtagtatgtctggggtagaaatttggttgcaggagagaggctgacacattcacaagcagcagcaagggaagagggattactggagtagaggcaagggagaatttatttacttaattacataatacttatttagaatctacagtgttcccggtatattgagttatatatgagaatgcaagaaaatgacatcactagtttaaagatacaatgtcttctgtttttcaaatgtttcgttgattttgttttattcaatactgtttagtacaatattaacagagtaaacaacagtatgagtccttctcatgtttcactttgattgtatcattgatatttaatccaacgtaaaattcctaaccttcaaaaaataattctcacttaatgttccagtggagtttgttcccaccatagtactgctggcctatcacaatgctgtaggtagttgtagacttgttcagtcctgttattggtggtgacttcctcatgtgctgggacctttattattcacagctgaattcccagagcataagagtgccttttttttttttttttttctttttttgagacagaggctcgctccgtcgcccaggctggagtgcagtggcgcgatctcggctcactgcaagctccgcctcccgggttcacgctattctcctgcctcagcctcccgagtagctgggactacaggcgcctgccaccatgcccggctaatttttttattttttatttttttttattttttttttatttttagtagagacggggtttcactgtgttagccaggatggtctcgatctcctgacctcgtgatctgcccgcctcggcctctgaaagtgcgagtgcctgttttttaatgtacaacaaatgtttcttgaagacacggcttttacattagcatattacatgaaagtgtgagggtcattaatatgtgtgaagaccagttaggattttaaagttctgatcagatacgttatcaagctgatagattaaattaactgattaatccaaggaattaacattaacaagcaatgaaatggtcagtatccaagtattgaagttgtatttgggttttacctaatattttccttgatcttactggctactttgttgtctaagctgaagaaaggccttcctgattacctttatttaaataaaataacagtggtgaaggtaatttcaaaaaatattaactatgctaaaacatatacctgtggtttgatatacaagaagctgcagaaggttctcagaaatatgtaaaacaatttattcccaaggtaattgataattgtatgcattcttacagaataagctgttataaaatttcaaactttatctaaaactcaatagcacgtctcataaaatgaactaaatagttctgtcgggcataagaatgtcggcttctagtatagaattccatgtatggtacaaaagttgtagagagattgtgtaattgctacattcatcgtataattttagaaaaatcctcttggtaatttatatggtaaaaattgactgttacaattagaaacataaggcatattttgtctcaatggattttattgagtatgctaaagcaatacacactacatatcgggtaagtgtgtgtactatgaggggagaagtatatggatacacagatcatgatttctatgtaaaatttatatcaggcttgtatgggagaagatacatgacaagttaaaatataaaatgaccacataattaaagtataatttaaattgggattattataatttaaatattttcccaagaatatcttgaatagtaatctttaaaatttttctttttttgatttttttattatacttttagggtacatgtgcataacgtgcaggtttgttacatatgtatacatgtgccatgttggtgtgctgcacccattagctcgtcatttaacattaggtatatctcctaatgctatccctcccccatacccccaccccaccccaccccaccccaccacaggccgtatgcagccataaaaaaggatgagttcatgtcctttgtagggacatggatgaagctggaaaccatcattctcagcaaactatcgcaaggataaaaaaccaaacaccgcatgttctcactcataggtgggaattgaacaatgagaacacatggacacaggaagggggaacatctgtaaaatctaaaaataatttagtttcaaaagataactttaaaaatgtctaaatgctagtggtaaaaattaaatatgtagatgatttattaaacattttaaaaacctcatgaaaaagggaatgtgcgacaaaagactaatttgcagctatcaaaaaataggaacagaaaaaatgtgctagcatattaatataaatattaggtgtcattgtgtgtccgagcaacattgttatcagttcccatctagtaatgactctctgtgtgtgtgcagtaaaatcaataataaaggggatgaataggacgactttcatttgaaactaaatctcttggaattgtgtgagctactgtgccacctatcagtggaatgatgaaataattcatacatgaacaattagcttaaataatcagcttaatttagtcaaatttattacaggcaccagtttacaaaaataattggtgcccaagatatttaatacttgggaataccagaattagagtatatcggagacaaagtgaaatctggatactcaatatgatacgacttttttgtttaaacctgcatatttaaactctcctttggtagttggatgctggctccccaaggatactcatgtcgaaatccctagaacctgtgagtatagtacatgatacatgacacaggggaattaaggttgttaattagctgatcttaaaatagggagggagattaacctggattacctgagtgcacactatgtagtcaccggaatgcttaaaaatgaaagaggcacaagagtaggcctgagtgatataatttgagaaagactatacctactgttgttcgctttgaagaatggaggaagaccaggggttaaggaatattggaggtctataaaagctagaaaagggaaagaaacatgatctcttctagaatttccagaaaggaacaaagccctgctgttgcttgagtttagtctaataagactcatgtcagatgtctaacctactcagctgtaagataaaacatttgtcttgttttaagccattaagattttgggaatatgttacaacagtaattgaatactactgcactctctgtagttttttttctgttcagtttcttagctctggtctgttgtacttggctgttcagctttggggcctgacaaactgccctcaatggtagaagtccagcagtgctcatttctatagggttcgggacttgaatcacaaaaggcacgaagggaaaaactttttccctcaccctagacgaaagtccatattttttttttttttttttgcgaggatctgacattttaaaagatgtttagcagtagaaatccctactgttttcagggaatattatcctctacgcttcttacctggcacagtcatgggacaattacatcaacacacaatactttgtcctatatattctgtattatttttaattaacagcatcaactgacaaatctatgttgaaccatatgaagcccaggtctcacctacagtctcttttccagtaatattcagacatatatcagttttttagaattcttgctgggattgcttcttgtatggttaaatgaatgtgctcatgtgcatgggtatataattatgtgcatgcacacatggacgtgcgcacactgctggacatccaaaattgagcagcgatgtgcacagggcataagaatgtatacttgatacttaaaaggatttctaaaatttttacacagtaactgttgccatccttaagatagctctttccttaagtatgcaaaaacagttgggctgtttcaaatgcttatggaagcatctgaaatttccttgcagaagaatgtctttgttttaaatttacatgtctaaataccaattggaaaggtaaagatttgctcaatagaaaggagtaatctgttaaaagtttaaaaaataccgatttcttttggaaaactgcgaagtcctgaattcagaggtcttattcttgtttattctaatcaccccatctgaaggaagcataactttccccaatgactgaaataataacagtaagaatgagaatacatggaaaatgatattaaattcttaccataaacaatcttaaaatttttgctttgaggttaagttttctgagaaattccatacttgcttaaaatatgtttttacaaagtaataactgccattattatttacaacacattaagtactatcctagttatttcaattgcatcctcccattaatttcctagcttggtaggattccccccccaaccagaaaccaaacttaaaaactaggaacttccagtccagtctgtatccctagatgtaagattctgacctggataaattgataatgctgcgaaacaaagtgacctagaaatccagctaatcttatcagtgctcgtttttaattgagaaaatctaattactcagataattgtggagcgtgttgcatactcttaattactgtaaaaacaaaaaaaaaagacaaatttatgctgctatataggcctcacgccctataaaactggatatacttttttatgacccatttagcttcattcattttatcagtgcatagaatgcagtatgttttccttatttcatactattttgttttactttttgtaaccataaaacatcagctttcatgcacaagcatatttttggttggatgagtttgtttaattaattaagcatttgagaacatcagtggtttagttttgaggtgtcacaaatagaaaaacttagggaaaatttctcattgtattggaaacaatttattctgcattaataagttgatataatttggctctgtgtcccctacccaagtctcatctcaaattgtaatccccacgtgtagagggagggtcctggtgggaggtgattggatcagggaggcggttgtccccatgctcttcttgtgatagtgtgtgaatgctcatgtgatctgatggtttaaaagtatttgacagccttccccccgaccccactgccctgtgaagaaggtacttgcttccccttcaccttccaccatgattgtaagtttcctgggggcctccccacccatgtagaactgtgagtctattaatcctcttttacttataaattacccaaccacaggtactctttataacagtgtgaaaacagactaaaacagaaaattggtgcccagatagtggggcattgctataaatatagcaattatagaagtgactttggaactgggtaactggcagaggttggaacaatttggggggggggtcagaagaagacagaaagatgagggagagtttggaatttcccagagacttgttgaatggctttgaccacaatgttgatagtgatacggacaatgaagtccaggctgagatagtctcagatggagatgaggaacttgttgggaactggagtaaaagtgactcttgctatgctttagcaaagagattggtggcattttgccccttccctagacatctgtggaactttgaacttgagagatgatttagggtatctggcagaaatctgtaagcagcaaggcattcaagatgtgacttgactttttctgaaaacatacggttatatgcgttcacagagagattatctgaaatgggaacttttctttaaaaggaaagcagagcataaaagtttggaaaatttgcagcctgtccatgcggcagaaaagaaaaacccattttctagggagtaagtcaagcctgctgcagaaatttgcataagtaaagagaagcagaatgttagtagccaagacaatggggaaaacgtcttcagggtatgtcagagacctttgtgccagccccttccatcacaggcccagaggcctagaagggaaaaatggtttggtgggccaggcccaaggccccactgctctgtgcagccttgggacctggcttcctgtgtcctagctgcttcagctccagccttggctaaaaggggccaaggtacatcttgcaccattgcttcagagggtgcaagccccaagccttggcagcttccatgtggtgttctgcctacggctgtgcagaaggcaagaaatgaggtttgggaacctctgcctagatgtctagaggatgtatggaaacacctggatgttcaggtagaagtctgctgcaggggcggagtcctcatggagaacctctactagggcaatgcaggggggaaatgtggggttggagcccttccccccaccacagagtcctcactggggcactgcctagtggagccatgagaagaggcccaccatctagaccccagaatggtagatccactgacaacttgcaccatgcacttagaaaagctgcaggcactgtgaaagccatgggggctgtgctctgcagagccacaggcgtggagctgtccaaggtcatgggagcccaccccttgcatcagcctgccctggatatgagacatggagtcaaggcagatttgggagctttaagatttaacgattgcctggctgcatttcaaacttgcgtgggacctgtgtctactttgctttgaccagtttcccccatttagaatggaaacatttacccaatacttatacctgcattgtaccttggaagtaactagcttgcttttggttttacaggcttgtaggcagagagaacttgccttgtctcagatgaaactttggacttggaattttgacttaatgccgaaatgagttaagactttgcgagactgttgggaaggcatgactgtgttttgaaatgtgatgacatgaggcttgggaggggccgggagcagaatgatatggtttggctatgtgtacccacccaaattttgtctcaaattgtaatccccacgtgtcaagggagggaactggtgggatattggatcatttgggggatgggggatgggtggttcccctatgctgcactcatgatagttctcacaagttctgatggtttaagtgtctggctgttccctgccccctcctgccacctagtgaagagagtgcttgcttcccctttgcctttcaccatgattttaactttcctgaggcttccccagccatgcggaactgtgaatcaattaaacctctttctttctaaattacccagtctcaggtattccttatggcagtgtgaaaatggactaatacataagtatactaagtgatagaactacctagaaagaataaatccagattaacttaagatgctcttggaatcagtgtttcagtgtaattgactgtggacttaaacagctttaatggagaagttgcatcttacgaattgtttctttccctccggtcttagtcccattacttgaaagaaggggtacttggtaaatgttgattacgttattaaaaatattttaacttatttttagtaaaattgaataactctcttatattacaatcgtggaacccttgccctttagcaggccatttctcctaaggaatttcagacatccctaatcttaacatctttatataatgtacatactgttgtgcgagtgtatctttctaggggcccatttatcttaaaccgactttcctatgttcctatcatttaatgtgtttttccattggtaatgatatatttcttctgttccaggatgggccagatatcagatatcacacattgcaagtgtaaactaaagcccagagcagaaattcaaatggaattaaagtataaataaaaatataggtcagacagaatatggataggttgtaggaatagatcagatgccagatgtagattttaaaaaacatgttcagaaaatatagtattgaaaactaagaaagagcactccagaggagctttaaaaaaggagagcgagagaaagaaaaataatagaaaataaaactggaggacattgttaagtgaaatcaaccaggcacagagacacaaatattgcaagttctcactcatatgtgggagctaaagtaaattgaactcatggagatagagagtgggatgatggttaccagatgctgagaagggtaagtggggaggacaggataaggagggagtggtaaataggtaaaaaaaaaaaaaaaaataaaaagtatatagttagatagaaggaatcagatctagtgtttggtagcaccctagagtgattatagttaccaataatttatatttcaaaataatagttaaattggaatttagctaacataaatgataaatgcttgaggtgatggatgccctaatttccctgatttatcattacatgttgtattcatgtatcaaaatatcccatgcaccccaaatgtacaactattatgtagtcataataactaaaataattaacgaaaatgaacctcatctaataattggacatttctctcgctagctataaataccaggctttcagtcagctctacttttagtttatgaatgaataccatagaaacacctgtaatgtcctccagtcaaaggtgttgatcacccaaagctgagcttgttaaatttacagggaaagggtaagcaccaccttcagggaatagtcatagcctctcagaagaggagcatgacggaaggatacttaagagttttacacgctgagctggatggttctaagtatgctctcgacagattggtcagaattagcttaccagatgagttgctgtgacagtctgtggtgttatcttggaacacatgagtttgcccgagtttctgtaaatctacttgagcttaaacaatttgatatgtttattttccccaaacgattttatgttagccatcacgggtaattatgcttggcataagggactcttgcttgatataggggggagtctgttgtatccgagttcttagatcatcctatattacatcctatattaactctttaggatacagggattgattagggagtgatatattagttcacttacatagggagaaatgatcaactcagaatatttttgtccctttaaaacgtctacctctatgtaagagtaaagagcataggctcttgagctgcactgtctttgaatcctagctctgctacctaccagatgtgtgaccttaaaaactttacacaagcaattagttcgtcagtttcctcatttgtgcaatgtggttaataataaatgggttaatgtatgttaaatacttcatatagtacagagtaaagactagttattgtaactcatgctattgctgatttttaaatgatgtttattttaattcaattgctgttcccccttgtaaacgtagaaagaaaaggttaggaaagggagatgtagaattctactaacaatgacttatattagtagttgggccaataggccctccaaaggagattcatcttgtgggatgtaagtgcatatagtagaatatgtcatgaattaataacggcattcaaaaatgaagcaaagacctgtttaaatgacctcagggagaaatcagaaacttttacagcagtatctgctttaggaaatagctagtgatttaccatttcaaattatgaatggccaaccaatgccctcatcagttaggcattgacagcccattcttctagttctatcttcttctgtaccggtttcaggtgtttccttctattactccttgaattggctatggcatagtcagagtatcaaaatcactggcttagttaggacctcctagtgctctatataaatatattggtatttttatctttttgacttggaatggtttcatttaacatgtaagatacttagatgttgagcccatccttgagaagaataatgtataaacctcaaagataaaacaaaatcctctcattcttgatcagtgcttttagtttgagcatgtcacttggattactgtgtctctggctctagcattaaaatagtcaacctctgaaatagcaaaagtggtacagaaactcgtatattttggagagtcatcacagggaatactatttagttatatttaaccaattgttgttatgcatctttcaggggtgagacactgaaaatattgcaaagacataatcacagcccttgatataatagtagtttgaaaaaagccgtattggggcacagaaggagtagtggcagagtgtgtgtgtgtgtgtgtgtgtattaacaaaatgggattagggaatttgtcaatgatgagatgacatttatgttttcacttgctgaaaactttagaaatctacttagtttgctaggtttgtagtggcttctgttttcatctgtagtagttacaccttaagtgtgacaaactttcatttacttaatcagtttcagtctttctaaggctggcatgatcactaaatgagaatagactcatcttaattttcacatggcttcaaaattatagaaatattaatccttccaaaaaatgtttagatgtagtccaaaagatttgtctgtggtctctgaaaagtgtttcactggagataaagctaatccagtttaaagtaactttgtaatcaaaattaatattgcatgcgctaatcataggctctccatgccttcacttctagtcagatccaggctcattgggagtcaagtgccagagaggtcctgcctcaggacctttgtacttgctgatcctttaatatggaaatgtgttttctccagagagtcatcacaggattcaactgcttatttcattcaactctatttttaaatgttcctgtagttgaaaggctttccctctctaaatcctctcttaagtagagccaacctctccatgccttttgttccctctctttaccttgctctatttttctttataggacttgccatgacctgattttgtgtagcatatttatttgtccttatttttatttctagtcctagaatttaagcttcataagttaaggactttgtacattttattcactgctatatctcctggtcctaaaacagtaggaacttaaatgtttaatgaaaaacataaatgaatgattaaattactaatagaatctgtattccctctccaaatgtacatttggtattgtactaatgtatataattttatgcaactcataaagtaatcgacatatttatattgctttcaaaattagcgccctcaaatacatttaggttagaaaaactaaaattaatacatcaattgatcatcaagcatagaaaaggaactccaagaacacgtaaacattttacatctaaggtcttactatacttttggtattaatgtatattgtattaaatcattgtaaatgtagttttctattccgaatagcaatactagaggaatttactttaaattctacattctctgctggatgatcccccaaaactgctgcccagataattacagttccctctcttagcttgtcttccagtctctaatttcctcctactttaaatcattgttcacatgccaccacaattagtgtttgaagatgacaggtctaagcatgtcattctcttgttaatacaaccccatgttctttctaaacaaaatccggctttctatgcctgccttttattgcttcccaccatgtgttctgtacccattcttaaactaaccttcagttacaccaaccttgggaatacatgttcctgaaccacaaaagggtttcctccatgtttttatcttacagaagtcacttaccttagtacttcatgcatagtctgtactaagtaagggtttattggtgatgactatgtgttcaatcttttaaaaactttgccactgtcctagaacttaaagatgactattccatgaagctggtttatatttcaaagataaaatgtcatatttattataagcctcctgtttttttttttttctggtttttcctggatagtaatgtttactcaatttactaataaaactagaatatatcacttggctataagctgtagtaccacagaatttgaggtgacacagaaaaattattcatctgctcttatatctttccaagggcatgattagtcttgatggcctggtgcaactgaattctattaattcttatttaaatcatcagaaacaaagtgtgatctcgtgtcactgaattagctaaacaaccttgctgctttaacacataagtgccaaaatagaaaggagcttaaaacaatagtttatatgtagcccaggtataagtccaatgtaggtgttccttattggtgactgatatggtttggctgtgtccccacccaaattgcatcttgaattcccacgtgttctgggagtggcccagtgggaggtaattgaatcatgggggcaggtctttcccgtgctgttttcttgatagtggtaagtctcgtgagatctgatggcttcataagggggagactccttgcacaagttaccttctcgtctgccaccatgtgagacatgcctttcgcattctgccatgattgtgaggccaccccagccacgtggaaccgtaaatgaattaaacgtctttcttttgtaaatcgtccagtctcggcaggtatttatcagcagtgtgaaaatggactaattacagtgactaatatttttctatatttttctgcctttgttgtggctctaccttcttcacagatgatgatgttttttgtttttttgttttttcatatagccattgaagagggggaagcaaatacagaaaagccacagtgacttcttagaagccttgtggtagaggtgatgcatatgtgctcccttcactttccacatgaaggggatgtgtgctcatgaaacatgtatatagccatgcctgtctacaaggataatgcagtggctggctgagtggctgcttctaagtgaaaaatctatactttaaaagctggagaaaggacatggttgtttgacagcctgtctctgccatagttaggaactatcagcttcataaataaaactatctggtggtcttctcaatggggagcttaattacctcaagtcaataagaggaaaatatccattagattcaattctatgttaagaaaatcgtggtcccagtgggattataatttctaaaatgaaggaatgtcagtaaatttaatggaaccttaagtataccatagaaaaaaatgatacattctgacattgaattttgttgatttaaataaatttattgtggtaaccatgctggttcccttcatgacatatgaatggggaattaaataatatacacaatgctttgctgaaaagtgttcaatttgtgttagatcagatacacttgtcttggtgacaaaattggcacaaagctttatgaaacccacgagtgggcaaagattgtatcagaaatatctaacggtataaagcaattttgtttttcattgttacgatattgacacatctccaagaaacacatccagggatgaatagctctattccccaaattctaaagacagcatctgacggaaatctaatttcagtcttgttattaaataagttttcttagtgtctgccatagtagacagtgtttgcaagatagcatattcattttttaacatatttttcttttgtgtgttataaataaaattaataaactgtcatattctactggtatccactgacgtttcttagttttactttaatctcaccattatgtaaattgactttgacagaatatttttagttgaaacattgctggaaattgaataaagttatgtgtgtgtgtaactcctgtgaaacactcaatgttatatctatatctcttatcaatagttaagcctttatgaaaataattgattctttagcatggtgtattgcacctttctcccaaacagagatttacagacacatagtagggtgtgtatatatatagatgagcatcaggtataacacataaatgcttatatatctaattggtgttgaggtctgaattaatgtatttttgaaagcatcggttcttgtgacagtagaatcaaatacttgcataatgttttatagactagttataatccttacaaaaatcctattgacaaaatagcattagcttaatattccagatgagaaaatgggctccaagtaattagatgctttgttcctgatcaaacactaagtggaaaaaaacccacctcattacaaaattttcttgttgaaagacttcagactgcctctaaaatagaggagagaagaaatagtctgacactctaaattggatataaacgtcagaattgggactataagtctagaaaaagtaagtatgtttaatggcacatatagaacttacagtcttaacaaatgaagctttttggtcaattttggagtatgatcttctataacacggaaaatcattttggggttttttttcctgaataattcataaatggagatggactaaagaaaatataaaggaaatagcataggaaaattttgtaaaaacttatttggatattttatgatttttctacatctgttttctaaattttacaccagggttccctttaaatggctacttttttggaaaagaaatctgagtatatacccatatgcaaatgagcctcaaaaaatactaggtgcctttagcttctgttaatatgaaattactaattcatgatgagaatattttattttaatgttagcggtgttgcttttggttggaagccaggtaaatgtaatcctattactatgcctataatgcggagtagttttgtttaatggtatgtattaatgcggcattggacagcttgaattgaatcagagaaatggtgttggcaagcattaaagactttaagagaatgcaaattttatatgcctctttttattgtaaattgacaatatataattgtataaatatatggcatacaaagtgatggtagaatttatgaatacaatgtggagtaattaaatcaagctagttaacatatctatcacctcaaagacttttgtggagagaacatttgaagtgtactctcttagcagcttcgaaatgagcaatactctattaactatattcatgctgtgcaatgcatttcaaattttcatcagaaaaatcagctttgaaagagtgtatgcaaaaattttataagcttctcagatgatatgatcttatatgtagaaaattctagagatttccacacaaaaaacctgctagaactaataaattaagcacaattgcagtaaataaaatcaatatacagaaataagttatattttatgcactaacagtgatgcagtccaaaaaggagattaaggaaacaattttatttaaaatagtaacaaaaagagtaaaatacttaggaattaaccaagaaggtggaagacttatacactgacaactacaaaacaatcctgaaagaaattaaacatttatttttataaataaatgaaaaggaaccccaggtttatgaaatggaacactcaatattgttgttgaggtatccgagttactcaaaacaaactacacattcagtgccatctctaagaaaatcccaattagtttttctgcagaaatagacaactctatcaaaaattcccatgtaatctcatggatccaggaatagttgaaacgatcttgaaaaaagaatgaagttgaagggtcatacgtcctgatttcaaaacttactacaaagctaccataatcaaaacactgtggtattggcttaaaaaaagggaatgtagaacaatagaatataatagccctgaagtaaactctactatatattgtcaaacaattttccataaggttgccaaggttttttaatgattttttaatgaagccacaaatgttgctaagaaactgaatatatacatttaaaataaatgaagttggactcttataaaatacacaaaaattaagtcaaaatggatcaggaagtaaacgtggccaaaagtacagaacttttagaagaaagcgtagacatttggaagaaaacataaacattagattgggcaattaaatatcttggatatgacactaaaagctcaggctacaacagaaaaattaggtaaattgaaatgcatcaacattaaaaacttctgtgcatgaatgaacaccatcagagtgaaaaggcaacttacggaatgggagaagatgtttgcgaatcatatattcaatagggaattaatatccagactgtgccaagaactcctatatgttagtccattcttgcattgctctaaagaaatatctgaaactgggtaaattataaagaaaagaggtttaattggctcacatttctgtaggctgtacaggaagcatgatgctggcatctgctcggcttctggggaggcctcaggaaacataaagcagaaagggaagggtgacctggcaggtcatatggtcagaacaggagcaagaggggtggagggagatgtcatacacttttaaacgaccagatttcataagaactctctatcacgagaatagtaccaagcggacagtactaaaccattcatcagaaatttgccccagtgatccaatcacctcccaccagacaccaactccaacattggggattacaattcaacatgagatttgagtggggacacagttaaattatatcatcgtagaattcaacaacagaaaaacagcaattaaaaaaatgaataaatgagttgatcagaaatttctctaaagtttggccagtaagaccatgagtagataatcgatatcgctgatcattagggaaatgcagataaatcccaaatgagatagcacttcacacccattaggatgatgattattttaaaacaccaaaaaaaaaaaaaaaaacccagaaaataaatatggttgaggatgtggaaaaatttgaacacttgtgaactgctggagggaatgtaaaaccttgcagtcactgtggaaacaaatatgttggtttctcaaaatatagaacgtagaattaccatgtgatccagcaattccacttctgggaatatactcaaaagaattgaaaaaaggaccttcaaaatatatttgtacacccatgtttatagcagcattattcatagtagcaaaagatggagcaactcaaatgtccatctgaagatgaatggataaacaaaatgtggtaaatgtatacagtagaatattattcagccttaagaaagttctgacacacattatagcatggatgaatcttgatgatgatatgctaaggggaaaaagccagatacaaaaggataacatatgattctatttgtatgagctatctagagcagtaaaatgcatagataaagtagaatggtggcctctagaagctgggggagagaaggtatggggagttatttaatggatatgaagttttttgggggaagataatttttggaggtggatggtggggatggtgacacaacaaggtaaatatacttaatgctgataaattgtatgcttataaatgattagaattatatgttttatgttatatatattttaccatgataaaaacctataagctttcttgtaaagttttagaaaatgtttggattcataagtgttggatgattgagttttatagtgtaaatttaatgtagttgtgctcaattgtcaattgtatgcctattgtctgtgagtatatattttccagattgttctctaaacataatttttaaccatttagttggaaaaaaaaaaaacctcaacttaaacccaaatggaattatgtagtccattcagtgcatactgtgaaatatattagtaacattttattcattttaaagattttcgttatcagtttaggaagaatgataattttataaatccatagcatactgttgttgtgtgcgggtaatactcattatttaggctgtttttaatttggggtcttttttaacagataatcaacaaacgttttttatttgcacacagtactcttagtatttcgttttgcttcagtaatagtaaatgaggctggggtttggagagcacgattgcttttggaaaagtcaatagagacatgtttttatcgctactgctttttttctatgttaattggaatttgacgtaaaattgattctgaaagatatcaaggtagacacttgaaatatagattggacaataaggttggtagaccattactgtgctttgaactagagtcattaatgtgattgtgaaaatttttactttgtatgttattcatcacttttctcccttagtggtgtttagagcatgatgagttgttactgtactgacaagtattagtctagtagtaatttctcataggctgacaagtgccaaaattcatcctcacatatgaatacactaaagcagacaaacactgttttcatctctgacactatctacagtttatcgtgatacattattttggcctacagggtcacaggcaaattatatttaatcactgctttaaactaaaacataactataaatatttttgcactctttaaatcagcataacaatccaatagacttcaagatcctgagataatatttaataacattaaaatgatttaaaagtataacgattgtattaaataattctgaataaacaatacttttgaatgaagaagattaattagcatgatcattatagaaatggtcctattaatacaaagatgtcaagagtcatttctggttcaagtcaattaagctacgttttaattgaaaaaagctgttcattgtgtacagcggtagcactcctgacatatcatataaatgaccccattaatgcaggagaaataaggtcaactgagacatttttactgaaaccaattatgttacattttaattgaaaaataaaagctgcttttattcaaaggaagcaccactgacactccatcatattccatagcctcctaatattgcagtaacttcctaagcagtctctcagttcttcgcattatacaaagttatctttttactacattaattaggtcatgtgttccctatttaacaccttctgaagactctacattgtacttagaaaaatgtctggagtctgaaagcagccagcaagaccctgtgtgatctgtcccctgcttgcttcttgatctcacttcacactggttcccttacttcaccaggctccggtcaagcaagaacatacttcttctccctctttatatagctgacaacttcctgccattcagtctgagccgaaaggtctcatcttcagaagaatcctttgcagtctaccatatgtaaaagagctctcctgatgagccctcccagccattcctgtatcctattcacacttcttgctttaaaatcatcatcattatctgaaattaccttgtttgattatctagcttatttcttctctgcttcccctactagaatgtttggtgtcaaggactttgtccgttggcttcagtactgtatagccagtagctaggagaatgccgaagagatggtaggtgaaaaatgtttgtggaatggataaataaatgaatagcaatagtacagaagtatgccatcttatttgttaataggtgaccatcggttgatagagtttcatttctcctgattgcttaactcagtaacactctcctgcaggagagctagtcaggactcagggtttttttgttttttttgattttttttttctttttttttctttttttgagacagagtcttgctctgtcacctagactggagtgcagtggtacgatctggcctcactgcaacctctgcctcctaggttcaaatgattcctcctgtctcagcctcccgagtagctgggattacaggcgcgtgcaactatgcctggctaattttttgtgtttttagtagagactgggtttcactgtgttagccagaatggtctcgatctccttaccttgtgatctgcccatctcggcctcccaaagtgctgggataacaagcatgagccaccatgcccagcccgaggactcaggtttaagtatgtgaacagatagttcagaagacgttataaactgttaatggaaagtctggaaggaacccagagatatgttttgtttgatctacaccttactacagatttgggtttctgttagcagatctagcagctctggggcaacattctgcaatggcaccatcctggtagtactgaggagtgctactctcctccctcaaagcgggcacattactgttcagtctggagctgcactcgccatacacacagtttatgtaactccactgacagactctgccactccagtcatttatggcatctgactttgattccacatggaaatctactgggtggacctgtcacatttaaagataatcatcatcatcattgtgtatgtgtgtgtataagttacattggccatttttctggggactgagtctgtctactccaaaagctgtgaaaatagtaatgattaaaagtcctcagactctatgattgtggaaattctttgtattctagaagcacacaattctaagacttctgagtgtctctcttcagtctcctgtgaagagcatcaccgatttatcactaaatgagcagattatatactggggatttagtgtagaatgtgccatacagtagctgtgcttcttgaagaaatccctggataggccaggtgggtttatggtaagagataaaattaaatagacgctgcaaaaaaaggagacaacattattaaagtcacaggaacaaatgacacttgtaaacatcttggacatgagttgataacatttaagtgtagtccaaagagttcaaataaaaaggcattgcaatcacttgagagagagagagaaataatgcccggagagtacatttgggctatattttagagaaaggccttgataggtagaaatagggaagaatagcattccaggtgaaatagcaaggcaaaagcaccaatgaagaagaaataagaggaaggcatattcaaggtatagaaaatcatgtcattatgtgaggtacaaaaagctatcgagtgtgcatttatatatgaggtatcatgctaggaacccaggatagctagatcaaaaggtatgcattaaagacattttgactaatttccaaatgatcataatgatgcctatatgcaacatcaatatatgaagtattcagtttcccattccttgcaagtaaacctgaatatgtttaacattatatcactctgttcttccctcctgcaaccataattcataagttattttcaccaattcattcaccaagcatttattgaacactatgtatcatgtctctgattggcactggggaaacaaatgtctctaatctcaagggacatacagtagaatgggagagagatacagttcctttaaattctggacctttccatttctcttctattttcaatagagcttgcagtcatggaaaatttattctctgtggcaacaaagtagggcagatatttgccctggaaggtgaagagagatagagaaggctttctgcctaacatttatcatgaggtactaacaaatatgacaattgaataatgctgttaaatactatgtggcatactgattccatttcacatacttatgtctcctctttttaatagaaggtagtgtaaaaagaagtcctgtgttacagtaatgtttcttttattatctaattgatccttgggtacgttacctaataattgggtatgtacatctccacatacatagcagtggaatagtaatagttggggggatttttgtgacatttaagaagaataattacaagagtcaaaagtataatataaacacaaaataggaactttccatttttcaatgcagatttattcagcatctttgcttctgattccatgtatttttctgcttcagaattctttttttatcctctatcttattttacagttaataatttcctgagggactactttctgagtggaaaattgttagaatcctgaagaaatgtatcacatgggcctgcctgggtcttcccccgccccccccccccccccaagaaaaacctgcatctgccttaaacataagatccagtagtcagtatgaaattcatcaagctaaagcttatctcgtctgtagttgtagctctctgaaactttaaaaaaggagttttaaactttgcatatctgaatttctgaggtagcattatatatgaaaccaaaaatatataaaataataagaaaattgctaaagaatcactttgtgaaatgatgaatccatttagcttagttcttctgtttggatatgatagccttattgccatagagaaattgaggtaaggcattaagagaacaagcaaacaattttgcagtaactaactcatctctcccatgttgccaggtgtgccgcatattgctgagcagtgaaaggattaagctaggaaagaaagtggggaaagtgctacctggaaatcagaatgaacattgaatatagaaatgcatctaagggggaatgagaaagagaagagtaaattaggtttttcttgagtcctgtctttgttacttccacattttgtctacaggattaagcattcagtgcctgataagtttagtattgtgccagaggaccccagagaaaaattagaaatgatcctttccttctagcaactttcagtgtaacttgagagtcaggactgaccaaaatagttcaataggtctgaagtaaaattatttgtgaagtagtaaatttcactttatagtgtatgaatgctgtagaaatatatgagagaaatcaacaagggctgtgatggaaaataggaaacatccagaagtagaagttgagctgaaacttaaagatagttagaattggataagataaaatgagtattcccagttgcaaaacaatgtgagagcatgtttcgaaatagagaagagggatgggcataggaaaaacatacagatgaagtaaaagagggcattttatcttttttatttttttcattttacatgtctgttttgtttgtggacgcctatttggtctcattgttctggctttgggagacaggcaggggatgctgcggagcacatggcccctatttgtggtcgttttgctccaggtgaaaataatagccaccctttattgaacacatcctgtgtttcaggcactgtgctaagctcttacactttgttatctcgtaatcttgagaatacctgtgtgagggcaaattgcagtaagagtaaatggggggtttgattccgaagtctgagattcttgcctttatgaccactgacagttaaggggcttgttacataattacaggaactcaagagtcttggtcgttgaataacaatggatcaagtgctgtgctgtgacccattattttatcaagtggatggaataaaacatgactactgtgttcatttggatgagtaggagaatgctgaactttgaaaggttatggaaggcaagcctgtagagaggtaccaaaatggcatgtagcaacacgcagggaggagaaagacctggatttaaatgcagtctctgccatctagagctgcgtgagcttgagaagtctgcatcatcttccctctctggcccctaaagctaaagaattaaaatgtatcaccactgctctctaagagttcagtttaagtgacagcaatagtcaagagtgtcagtttgagttttcccccaaagcaaagcctgacagaaagccatgattggctgattatcaaagaaactagtaagaaaactcaggaacatgtgggacctggaaaagtgagacaaggaagaaggaaaagctaataaagataacattgttgaactgatgaccataataggtaactgtacctcaaccttgcctgggacattatagaaccttatagaactgtcctcagaaatgtccctttgaaggacaatttattttcctccctcctcttcctcctcctcctcctgttgctagagctaggaagtgaaagggtgttaaccctctaacagcagaaacaggaactgcagcaaaaatgagagatgggttgatgggatacagtgcaaaatacaaagaggcatctactgttcaaaataaacctataaaggaatctgtattagtctgttctcatgctgctaataaaggcgtaccaaagactaggtaatttataaaggaaaggtttaattgactcatagttctacatggctggggaggcctcacaatcatggtggagggcaaatgagcagcaaagtcacatcttccatggagacaggcaagaagagaaagcatgttccgggaaactttcttgtataaaaccatcagatctcgtgagacgtattcactatcacgagaacagcatgggaaagacctgccgccatgattcagttacctcctaccaggtccctcccatgacatggtgggaattacgggagctacaattcaagatttgggggaagaaacaaccaaaccatatcagaatcgaaagaaaaattataaagtcaaagtagaggaaattctggagagccttgaaagttgggctaaaactagatagaatgtgtatgtctcaacattttctattatatccctgaatcatataacttgttaagaatggggttacacaaaatttcagttaggttggagagggaaattcaagagaactgttgggtgtatataacaagactatagttaatagcaatgtattgtatgcttgaaaatttcaaaaagaatagactttaaatgttctcacaagcatgtgaggtaatggatatatcaattggcttgattgagccatttttaaatgtatatgcctatcaagatatattgtatactataaatatataaaatttgtcatgttaagtaaattcgaaattagaaaaaaaatggagctaatctctttaagagttaaaccctgaattgtagggaatttcttgctgacgaagactaatttggtcttgaagagaatttcatgtcaccatgaacttatggcctgacttcaaaccagtgatgagctgtggagggatatagggcactttgctttccatcagatcctctcttaagctgttttgcatcacttaattctaactgtaaagttgggaaaatgtagatggggcaagtgacagcatatggtttgatatatacttgattgtatccataagaacatcctcttacctttttaataagtagcttggagtgcttcctgccaaggctttcaccagttatccagaagattaaaggctgaagtagtgattgtccttggaatgtccctctatctatgtgtagatctgtggttttattcatttgtttcccaaattgatccacaaggagattaatcttgtatttttttcctgatgacttttataaactagatgcgtaagacatataatattgacatcatatcaagttgcccatagggttatttaaatatttgaagagatgtgtttgttctcttacactctctgaatgcttttggtttttagcgattttattgtcatcaaaaaccatattcgactacacatttttctgacctactagacattcacatttagctttgggtactttgtcattgtagaagcaagtataaagtaatgaaatttatgattcaatcagaaaacaagtattgaagctgctgaaatatgacgttctcagctttatttcttctacgaaaagtccaggttaatgtttataaaatatttttaaacttttttgtctgttcaggactgaatttcttgttgagccggaatggtgagataattctttcttctgtggaacaaatgcattttaatgatagttacttatatgaaaatgttactaagatttaatttatgcgcttaatgctgcttaaaataaatgtattcaataacaaaacaaagccaatagccatagcacattaattattgaatagactttctgtagttactgcaactgaatgacaggtagtaagaccttaatatttgcaatcacaattgtattcttctttgccctagattaagcttgctgattacagtgcaatgaagaaaaattaattagtttgctccagtggagcagttaatatagcacaagcgaaacccataccctgcttcctcctgtaaccaacttgttttcacttactctgccttttgatacacaaccattttcttgatcacttcccaattgaggaaaagtttaattaagtagctaatactatttagaaaatatagtgctaaggaaaaaacatgttattaaattcaaaccattgatatttttattgctatttaacttatattttatacctggcaagcaaataattgaatattgtttgaaaatatttgtaattaagaactcaagaatatgaaaacatcattgagttataaaacatgtattactcctcaaagagcaaatattcctgtgttgggctgctcttagttggagtaaacacattacctgcccacagggaacttttcatctattagaattcagaatacatttcagggattcttaccaaaaagatttagaatacagctatatgaatttatagaaatattttaacttcagaaggattgtgtgctcacttccgtatcttcctttaagattttagtcatgttccgttttttgtgttttttttccttgtctgaagacaatatttttagaggagagaatttctttgaaattgatactgtaagtaaatttactgtatttacttagaactactcattcacccatacaaaaaaaaagttgagctttcattattgagctctcctcattatgttataaaggaaaaagacattgtccttatcatgggagacaagcagatacatgggcaattcttcagcaatgtgatgagtagggaaagacatacatgatgtgggaaatagtgttttacagtcaggtcatgcattgaaccaaaactcaggccgtaaggaaaggctttgaaggggcagtggtaacttacctgacatgtaaaggagccagatgaaaaggatgttgcaggcagagaagctgtaatgtacagagaactgaaggtaaaataaaatatcagcttatggcttggcaaacactatggggaaagaggcacagaagtcacaatgatagtgggagccatctgcacaatgatttaatggctagggtgttatgtacagttatgtgtcttgtatattgcatcatttctataacagtataaatgctattgagtataaattagatatttattgacctcatattttacagatttgccgtgaaaatttctgtatgtttaaatctgcgataagtttgttattgactcattcatctaaattaatagcttgttcttcagaaaagaagttttgagactggttgtgatggtctcatcaggttgaagagatcatacttttactgtggcacctattttttttttttaatggtttatttctatttgagtaaaacagtggctaaggttctatggtatcgggataagatggtgataagtgatctatatgacagagttggcagaggaattaataaccatattgacttgggagagtgagctctgtatatagaatacacattttagtcaggagggcagagtggtaaaagtctgagatcttgagatgcactgcttgggtttgaatcctagctgtattacttaaaagctgtgtggccctcagaaagttagtcatactgtgtttcagtttcctcatctgtaaaatggcgataattgtatccatctgataagattgttttgaaaatatttaagtttaacatgtatgtatgtagttacatacatgtaaaagtatttaaaaaggtgcttggtagatattaagtgaccagcaactctaaatattgttttattataattagtaagctaccacaggttctgtgctgctgaataattgatcaataccttacataacatcagcaaaggggtaattttcaattttgcagatggcacaaatctgggtggggggtcaaaatgaagatgagaatttttcatgataggctaaatcacggggtcaaaacccacaaaatagaattgagcagggtttggtaccttcttaattgcttgcttgctttattttcaatggcttgttatgtaacaccaaccatgtggtcaacttgctaggttatataaaggtgaataaggctcggttccttccctcaagaacatattaacatgtagacgcaagtacagaaagggagaactaacattgtattataaatattctaaaaatgctaaattaacagaaatatgatacaaagtatagtataatgtagtatttagaggagataatggtttcacactcctttgctctgacaaagcatcaagagtctttagttatttgtgtcagattttaagaaagccaattaaatgttatagaacacccacagctgagggaagaatttgtactgaagcttggttggagtatactccctgtgtggcttactatgagtggcagtgcagagggtttgtggtggtcaaataggaaatctttatgagtatgaaaaacaaatttctaaggtagactcaatgcaaagtcgaaccacatctggaagaactataaattccataaatgttcattaagcacctcctatgggcaaagtgttctgttaggcctgaatgaatttattgaagacataagaaaaggctcatgtcttggaatatattgtcttttgaggaataccagcataattatgattgtataatagtttaattttatttttgatgtgtactatttaaaattcagagtgctataaaaatagtaaatcagggaatctgtatctggaggaataagaaatgaagtctttttgaaggaagtgatatttagatggaagtctgggtactagcttgttgtggagaaggaagagggtaaaggcatgagggaggaaaatacaggtggggatggaaaggtgttctaagcagggagaagtcagtgcttgtgtattagtccgttttcatgctgctgataaagagatacctgagattgggtaatttatacagcaaaaagggtttaatagacttgcaattctatgtggatggggaagcctcacaatcatggtggaaggcaaggaggagtaagtcacattttacaggaatgacagagggcaaagaaagcttgtgcagggaaactccacttacaaagccatcagatctcgtgagactttcactaccacaagaacagcatgggaaagacctgtccccatgattcaattacctcccacagggatcctctgacaacatgtgggaattcaagatgagatttgggtggggactcagccaaaccatatcattccacccccggcccctcccaaatctcatatcctcacatttgaaaaccaatcttgccttcccaacagtgcaccaaagtctttactcattccctcattaactcaaaactccacagtccaaagtgtcatcctagataaggcaatttccttctgcctgtgagcctataaaatcaaaagcagattagttacttcctagatacagtggggttacaggcattgggtaaatatagcccttccaaataggagaaattgtccaaaacaaaggggcttcagggcacatgcaagtctgaaatccagcagggctgtcaaatcttaaagctccaaaatgatctcctttgactgcgtatctcacatccaggtcatgctgatgcaagagaggggttcacgtggtcttgggccactctgcccctgcggcttttcagggtacagcctccctcctggatgctttcatgagctggcattgattgtggctttcctcggtgtgtgttgcaagctgccagtggatctaccattctggggtctggaggacagtggccctcttttcatggctctaatagacagtgctctagtagggtctctgtgtgagggctctaaccccacatttttcttttgcactgccctagcagaggttctccatgagggccctgcccctacagcaaacttctacctgggcatccaggtttttccatacatcctctgaaatctaggcagaggttcccaaaccgcagttcttgacttctgtgcacctgcgggctcaacacgacgtggaagctgccaaggcttgggcttccgccctctgaagtaacagcccaagctgtacctcggccccttttagtcacagctggagtggctgggacacagggcaccaagtctctaggctgcacaccacagagggaccctgggcctagcccacaaaaccattttttcctcctaaactccagacatgtgatgggaggggctgccacaaaggtctctgacgtgccctggagacatttttctcattgtcttggtgattaacattcagttccttgttacttatacaaatttctgcagtgggcgtgaatttcttctcagaaagtgtgattttcttttttatcacattgtcaggctgtaatttttccaaacttttatgctctgtttcccttttaaaactgaatgccttaacaggacccaagtcacctcacgaatgctttgctgcttagaagtttctcccaccagataacgctaaatcacccctctcaagctcaaagttccctataactctagggcaggagcaaaatgctcccagtctctttgctaaaatataatgagtcacttttgttcgggctcccaacaagttgctcatctctatctgagaccatctcagcttggatttcattctctacatcattatcagcatcttggtcaaagctattcaagtctctaggaagtcccaaactttcccacattttcctgtcttctgagctctcaaactgttgcaacctctgcctgttacccagttccaaagttgcttccacattttcacgtgtcttttcagcagcaccccactctactggtaccaattcactgtattaatttgtttttatactgctgataaagtcatgccagagaatggataatttatacaggaaaaagagtttaatggacttagagttccacgtagctagggaagcttcacaatcatgctggaaggcaaggaagagcaagtcacgtcttacatggatggcagcagacagagagcttgtgtggggaaactcccccttacaaagccatcagattttgtgaaacttattcactatcatgagaacagcacgggaaatacctgaccccatgatccagttacctcccactgggtccttcctacaacatgtgggaattcatgatgatatttgggtgagggcacagccaaaccatatcagtaggtataagtaaaataggtgaagggtggagatcaatcagaggaaagcacaccaaataggaggacaagttctcaatccactgcaaggatttgatttgtagtttggctttcaggcctttaactgtcttcagcttggaagtggggtttcactgggtacccacccctatctgcctaggagtttggctctgcttcctgtcactgtcatatgcacttctctgtggtttccaaaacctgacacagggaagaaatacaatacaggtatctgatttatagcaatctgttataaattattgaatgaatatcatattttaaattcatacctgatagatattttgcacatttcttgatttacttctaaaataagtggatttctcttctttccaaatgtaaatcaaatttcgcctaacttcatatgaaacacgggaagtttttctcccttttgtcagaatttttaaatgtatttatattttaatctgaagaaactagctttctcaaggatggatagagtttgaaaatgatagacatgattcagttttctaactctaatgctatgctagttttcatagagtttatgattaacataaatgtagcaatatacatgattttccgttagggaaaaatctctgtttattcttaatgttgtaaatcacaagtcaataaacacttatgagtgtcttctatatatgtagaaatgtactaggtttcatgggtaaaagtgacaaataaggcaaggcgtctgttttttcatccaatggaaatggctcacaatcacatttcaaaaaagatcagtgaactgtatataactacctatgtcttaatatgaacaaattgtgattcattggttcatataacagctgcaattcctaatacctaacatcaaatcttttttgctatgtgtggtgttagccacataaattctcactattgattcaataatgagttttttggcttttaattgtgtgtcatttttttgttgtttacagacatgataattttacgtagttctgccttggtgtctacctcaattatcagagtcttaaagagattatagcaactgggaaccctaaaagccttcagcaaatcttggctttagccaggatcctcaaataatgtccaaacgtgttaagaacttgaaatattgaacatttccacttcatttccattcattctttccatttccttaggaaaattctaataagaaatgtaattcttaggagcagagagcaggggaagaaaacaggataatttataaactgtttaataaccttgtgagcaattgaatgttgaccatataaattctggataatatcattattgtactcaggttggctgttaaaaagtcataaaggaaagaattttaggcatctatttctagataactattaaaatggtgatcttatcattgcataccatttagctggggagacagaattgtatttaatgaaatgactcatttgttgtattggattcctgccaaattatttcatggtttgtcaaatgataatttcacaagtgtcagtgacaagatgttggacattagttttctcttttcctatctgctgagtcacagttctcaagggatggatattatagtgattcaatcacaccttagattttggcttacatttactaatcagtctagtaaatttggtaggggggaaatcgtgccatagcatataaaataatgagttccatttcctccccacattggcttctattttttgggttctgtatgtacctaggacctaatggggcacttgccacgtaggtccccaatgggagaaaaggttctgttaattactccatcacattaaacagtccagttagtacccatagaggtgaggaagaatgtgcttatgttttatgcttcaggcaaagtagctaatcagagagctgtgaacaattgtaaggaagtgacttgctgcctggttctctgcaatgactgatgacacagtctttttacatcacagaatgtgtaaaatttgttcacatgtataagctcttgttactttgagagggcaattctgggataatttggttgccatattatacttagtcaatccctatgtattgataatctgttttaatttgcatgttgatatacttactgacttacctaataccatcatttatggtttgagatatcattcttaatttccctttaataatacatgtaatgcatgggtttacctagccctaagactcatttcaaaatatattttctgaagttctgtagatgtaattattaaaatcacaaactttcaaactggactcataccccagctggctatggtacttaatgaaaattaaactttttgctcctcagttttcttatctgtataacaggattaaatgccccaccctcgcagttttccttttttctttttcttttcttttcttttcttttttttttttttgagacggagtcttgttctgtcacccagtctggagagtgcagtggcatgatcttggctcactgctaccgctgcctcccgggttcaagcaattctcctgcctcagcctccccgagtagctgggactacaggcatccgcaaccacacctggctaattcgtgtatttttagtagaaacggggttttgccatgttggccaggctggtctcgtacttctgtcctcaggtgatctgcctgcctcagcctcccaaagtgctgggattacaggtgtaagccaccacacctggcctacactttttctttaaggataaaagggaaatacgtgtattaccattgtgcttgtcatatagtaagtaccaaataaagagtagcttctaccattattaaaagctatcctggcttttttactattattaaaagttattcaaagcctacatatagaaggcatagctatatgcctttgtgtcacatgaatagtcaacttttctaattttttctgtggctgtgctttgctctcaaagtgtggcctgcatcagagtcatcagggaaggtggtggttaaaacggattcctccccggcatgttggctcacacctgtagtcccagcactttgggaggccaaggcaggcagatcccttcagcccaggagttccagacaagactgagaaacacagcaaaaaatacttaaaaaaaaaattagcgaggtgtggtagtgcaaacctgtagtcctaactattcgggacgctgaggcgggaggatcaggattgcttaaacacaggagtttgatgctacagtgagtgcatgatcatgccactgcactcgagcctggacaacagagtgagatcttgtttcaaatacagtaagtaagtaaataaataaacccagcaaaacacagatccctaggtctcactctcacgcttgattgagtatgtctaaggatgtgggcaagattctgcagccacaactgtctcccaggtgaggctgatggtactcgttctccaactaaagtttgagtagctttgccctggagtagctgtcccaaacaggttaatcctcagaattgcctgggaagatttaaaatatatttcccaaacataactgaatcaaaatttgaggagacattgtaaaaaatccatttgaaaattgttgcgcaaattagaggttctcaaacttgagtgcacatcagaattttctggaggccttgttaaaacagattgttgagatacggaatcaacctaagtgtccattaacagataaatgaatttaaaaatatggcatataaacacaatggaatattattcagccataaaaagaatgaaatcctgtaattggtggtaacatggatgagcctggatactgttaagtgaaataagtcgggcacgaagagataaatatcacaagttttcatatgttagagctaaaaagtttgatttcatagaagcaggcagtagaatagtggttagcagaagccggggagggtaagagggaggagagggaggaaagggacaagctagttaacagatacaaaatgataagctaaataggacggatatgtactagtgttctaaagcactgtaaggtaacttcagttaacagtaatttattgtgcatgtttaaatagctagaagagaggattttgaaacttcccaacacaaagaaatgacaaatatttgaggtaatggatatgataattagcctgatttgattattacatgttatattcatataggaaaatatcactctgtacctcctaaatatgcataattatgtgtcgattaaacattaaaaagaaaacacagatttctgggtctcactccctgagatactaaccaagtaagtctgggagagtcctgaaattcggtatttctaaaaaggtcccaggtgacgctgatgctggtctggatccacactttgagaaccatagcctgccctagaccactgcttcttaactcattttaaaattaaggatctgtgtgagattctgctggatggtgtagattttcttgaaaaataaaaaacgtgaacatagtttccatatactttccagtgttcatggatcccttgaagtatgtctatgattcttgtatgaaagcttgactccagatagaacgtctttgagtaacatatcccaggttaggaatggaattctctggggctatttgcaaatctgtctaaacatgggaatatgccagtaacattttactccattacccagagaacaggaccaagtcatgttattacctgtagaatgataagagactttcaattctaagaattatggcttatttttacaacttgttggaatatgatttgcagatttggtgaaaatggtagttacttccacaaagatgtttaacaatttaaaagttctagaagtttgtgtttcctactggctttattctttatttttactcttcaaatctagctgttcgctgtctttttcctgaaacatttttattaaggaaaatacagaattttgcagcttatcagtttaaacagaaaacatccctgaaaagtcttcgactatatgactacattacttatacaaatcgtgatcatagtgaaactgaattactttgtaaataaccatgattcattactataagcagggttttgaaattatgactacctcgagaaaacttttattaagaataaaaaagcaactatctcagctggaccaataatagaaacaccagtatattcactcgctttttatttctcaaagcacatttgtggcttgtagccaagaattcattgcattgaaggagtgtttgacaagcagtattgaagctgtaaacactttgaactcattacagtgtctcaccataggaacttaactgtcactgaagacaccctgtctgtgaaaccatcattcctacaattatttttacctttgcctgaaaatatgcttttgtgctttaaggtatttcaaaagacaagagaaagatggaagctaaggaggctatagggatttcctgagttctgtgagtgctgtgttgatacagaacaagatcagaaacttggatatatatgtttcaacttaaaatgctgattgatcatcatgacaatagttttatagagcatttgtatgggggtgaatgtttgaagttataaaaagcattgtaatgttactcattcatgggctgaacaaacatttcctctttctctttctctggctttcttgccaattacttttttcttgccaattacttttttcttgccaaaaacaactgagatcacccccttaagtccattttgaaacaaacttagcaaggagtggttgttagtctgcaataacaatctacatctcaaactcacatccttacagttgttgtgtaggtatcatagctgcgtgaaacagtgaagtgtaagattgtgtctacagtggtctggaaaatttgactcataatcacatgtagaatacagtcctttaagaactctcccaccccgcatcactgccctgaagataatgagccaatgatcctgatggtaatctcttctaaaatcatacgtatttgagaaaaattgtatcttttcggagactggtaatagtccagatgaaaagtgtttatatcctgaacctagagtattgacaaagcagatgaagaggattgattgggatggagaagattcattgatgggacttaaggaatgactagatatgacaggatagggaggtgaagtatgctaggatgatctgtatgataatgtcttacacaagtgaacagaagtccagtttaaataacgaggtttggagggagggagtaaagaagatggatttcatttttcttaggtctaatttaatgtgcttttggtaaaatgtctactaggccaccatgtatatgaatctgaaccttaaaaaggaggtttgagcagataggtgcacagtttttaatcattagcatatttaacagttgaaaccatgagagaatatgccttatgagaagaagacaccaagatcacacaatgctaggaagaccaaaaaggttgtggcagagaggtgggagggttgatcatgagaggaataattaagtactaaattccactgaaaacattaagtaagatgtgggttaaaatagtttattagatttggcaaattggaagttttgataatattcaaaagagcaactttggaggaatggcaaaaaaaaaaaaaattgtaagaatggttatccttcctagaagatggttgcagaaatgattcagaaatagcttgtaagtagagggtaactgaaaagccctgagtgtgcttactagctggtgagagagggtttaaagatgaatatgtgttccttaaatccattttgtgtgtttatgaggacagggtaaatagtctagctaaatcaccacaccctgccctgtgcctagcatagtttctatatatttattaggcaccaaatattttaggtatatatttttttatgtaaaatatatagggaactgtgtgaggccctggaagaaacacaatgtctattttcattgaaaaagagctacattggagagactaaccacccatcactcaatactattttatttagttgtataagtaatgggtgctatggcagtttatgacagacagacctgcccttatcttgggggaaccacagaatgctttacagaggaagccatttttaatgttctactgagagcaaaatagaacttcctcccattcctcacccactgaacacattccacagagttaaaaactctgctttccttccacggtcacttttcttggcattcagaaattattggaaactgtaactatgggttcagtgccaacaacattctaacactcatggttagaatcctaaccagaaagagtacaaataagggtcctttcttttttgattttggctcagatatcgatgttactaataatgataataaaataatagtttaaatttaccctgtctttatgattttcagaatacttcccccttctagtttatttgggatgagatgctagggaatatgagtaggaaaatgataaagtgagacaaagaaggaaggaaagtcaatgaagactacatttcaagagtttaaactgtggtggacaactggcgctcaatttgactggggacttgaagaaaattatgtggaacacacacctcagacttatcctttgaagagatgagaatgctaaggtatttatacaccaactcctgctggtcatctgttggcagatcccgggaggggctgtgcattcactccctagcatttttgatctattgcatgcactccggaagaacagactccagtaggcaaagagatgcaggagctggcaggtggaagttggaacaatgtccactgaaatgcgaaggactcagaggaagagacagggtatcatcagcaccagcctaatggggtttgaatctccattttgccatttactagcagtgtgatctctggcaacttacttatcctctcttggccttcgtttcttcatctgtaaaatggggatcataatagtatctacatcgtaggattgcagtgaggattaaataaattattcatgtaacaattttacagaagagaacatgaaaatttcgaaaagattacttacttgtcaaatatcacacatatgggaagcaggccaaagccttgattcttggccccagcctttttccttatacctactgcccaatgtctgtgttgccttgtatcttcataatttacttcccattttctcattgcttaggtctcattcctgattcttttgtcccatttactctcctctaaacccttgtgattgtccagatgagctttagcttgggtgtctgtgtatcccttctgaatatttcatgcttcggccttgcccagcagcttaaacttacactattaactcccggtcttctctacctcgcatttttcctcttacctatgaggcatcttgacctataatattttcacttccaccagctgagtctatctgtggcacatgattacttgtctgattccttgttctcatggaatccttaggcttctctgatgtattttatcctattggcattcacatcccagtgggcacgaagaatatttaataaaaacattggctttattttagaacggaataaacacatcattctttcctcctaaaaataaaagacatattagttggattgtgtcattactgtagagtgatacaagccagaagatgcagtgacaatatcagaatggtgtgttatctgttaccaaagggaatgggtggtagctgtgtaaccaggtcatcatagtggcatgaccatagccaagtgtacggcaccatagtcaagggcactgaacaggtcattagttgggattgagtcaagagttggaccatttgacatggaacacacattctaaaaatatattaagttggtgcaaaagtaatcacggtttttgccattactttcaatggcaagaaaatgcaattactgttgcaccaatctaatagtaacataaacatcaagcggcttcaacttttgcctaacaagtttatttaaaaggttctaggctagtcatgtttaaaatggaacagctttattgagatataatttatatgccatacaatcatctgtttaaagtatacaactcaatgtttttagtatattcacaggactatgcaaccaaatattgtgttggtattataccaattagagatatgacaaaagctttggaccctctcatgcacatttgtacaaacacaaaagaatttgcatatgataccagaaaattcatggacttctctgaagtccatttatatgcccagaagtactactcgttcagccaaactctatcttaaggcagctattaattctgtttgtacaatccagcagacagataaggttgttgatcgtcttatggactcatggatatcaccttaacgacaacaatatatgtgccaagtctggctcctaaagttttaggattttgtgtttaaaaagggggagaaaagctttagtatgtttcgaatcctaactgacagtgagtgacaaaggtttgaaaaaatatattgcagatgtgtgaacatctggaggctaattgtacatgtttaggtactccataatctcatgaaaacttttgacctagaaatgtcagcgctgttgccctctcaaagagtcatgattctttatcacatcgctttattgtaaaatggaagtacatttagtggcaatatccgtgtgattagctatgtccagtcatcagatttttcttgcgttattatgattattacagattctattacactatgacattgagcataaatcaccagcctccttctcggcacatacaagagtcacttattttctaaaggttaccaaatatactaacttgtttaaacaaacgtacacacacaccttcctatatctgggtaggtacagactcagataaatcttcatacaacagcatgctataatgaaaagaacttaagttttagagtcataaataacttgatttgaatccatgagtatatatttacttactgtataatctagggcatgttatgtaaacacttgagaattcaatgccaaccttgggataacaaattttacccagcaagtctatgagaaagatcatagaaataacgcatgggaagtacttaaaacagtgtcctacacatggatacagatcaagaggtagtaaatacactcacaaaatggtctaattaagaaagtcttccatgagtttatgccctccaaaagatgagattcgaggccaattttgtgtcataaactttatgcttttataatattcatttctattttatgattatataatgcttaaataataatatagtaaatattcatgtaaaattcttacaccgaaagataaatattgttaatatgttggtggtcattaacttctccttctctctgttctttctcctctcttatttatgtgacaatatatgatccttttttctgaggtttaatagtgattcccatgttttcctcttccatagataccataaatctgttgatacacatgttctctttaccatgaaatagatcccttctctgtaccatggcccctataaatcaggatacactacattatgcatctataagaataattctgatatctcagcgactcaaaagaatagaattttcttcccgccaaacttcatgtcactatagattggtaggcgtctcaactcattgtactcagctgaaggacctgggctgagagaagggtcatctcaatataaactttaagaacgcaagagaacatgtgaaagcacacgataacccgtaaagcttctgcttggaaatggcgcacatcacttctgttcacatttaatttgatgaagtaagtcacatggccatatcaaagtacaagtaggcagagtaaaagatactatcaggagcctggaataaaagaatggaactttggtgaatagacttaatggcaaccacatcccttaaaacaagggttctcaaacttgaacatgcatcagaataacctagaggtttgttaaaacagggagtgttgggatccaccccctgagtttctcatcctgtaggtctagagtacagccagagcggttgcacttctcacaaattcccagttgctgttgattctgatgtctgagaaccacactatgagaactgctgccctaaagtataaaagctcttctcttaagattccacaatggaaaacacttcaacagtggtactttcgactgtccatggtcacatttcaaccacatacttctcaagtttccaaatttatctcaatctccaaccactggtctgttaataatttcccaaaattgctgtattatttcttttcctctggtggaatttaattaaaatatctttcctacaaaccttttccaaatcattctaactagaagtattgcctataccttttccatagtagtatacacctttccaaagtgatcacatgctttgtattatggtaatcttacacttgtgtttttctcagtttcatgaactgttttcaagcgcactcatagaaatttacccaaaatgaatactaaaacacttaattttttattcctgattttgccacattagggtaaaagacttggccacatgttctaaatttaaatcactactcttgtctcagaagccatgtgaacagtagggaggacagcataggttctggagctggactgcctgggtcaaaactaaccttgccactttttagctgtgtaaacttgtgcaaatttcttaagatccctgagccttttcctcatctagaaaatgaaagtgagaattgtattcataccataggactgttacaagaattaaatgaattagttgatttgaaacatttagtgcaggacttggcaagttttgagccattataaccattataattgcaaaacatcctgaagttattctctatgcctgaagttacattttcttaatatccattttctccttaatcccttaaaagctgtcttctgcctcatttattctatcaaaactgtattctcaacagtcactaattatattctaattgaatttcagagtgaatttcacacctctccttttgaaagattcatttctatgaatttgggacagcttcctagtatgatattccatctataagtatatccatatcatctatatcgtataccttatctgctctgctaactctttccttgtgttattatggatgttctccaattctgttctgcagacgggtgacaagtgaacatgtagaagaagttttcagtctcctagttttacctccattcaattaactttaaaatctacattactagttctgctgtgtcaccggcagtccaagaaaagaaacctgatcagtttgtgaaaatagctaatatttaatatgagcttattatgtgccagctactttacctggagtttcttatttaagccttacaattgctttattaagggctaggaacttcacatgtacattaaaatgtagaagcaaactgttgaggagagaaaggaatttacccatattatacagataactaataggaagtagagattggatttgaatgaatccaggactgatgtcgaagcccagtgtcttaatgttattttgggatgtctgcatagatttttttttctttataagggagtgatgattttaaaagcaacaagacccaccttaggtaaagtccatcatccaaaaccaaactcagttttattcctgtgcctacgcaaccacattattggatgcctagaaaatgttcaaacttctaaccaagtcactggtaaccctctgtgattttggcttaatcaggtttattcatcagttttgcccatatttcacttgagctctagtctcattaccttaattacagcttcctgtatgtctataggcttttgcttctatagacccaatttatatggtatcaactctatatgaagccgtttttgaatctcctagtaatgctttaattttcctaaaattcctgttatatcaaatcagatttcttttttatttttttgtcagttataagtttattttttgtgagggcaaaaataaatttgttggataatgagtttgtgagtagtagatcaatttgttcacatattttgcaaaagttagagcttattactcattcatgtactattgatgtaacgcattagaagacagttaacattagttcctaattgcacctgaccaaaaggagctgtgggcctggcctatacaccttattgcgtgttcagcatcaactgatttagtgaagcagcaaaaagaaaaatggtgtgtgcagtattatctttctgccacagatacatgtttttaatttccaagtttccaatgcatcattcagttttatctaatgggaatgcagctgagagaagtttgtatcaacccaaaactacatgctaatatagtttagttttcaagacttgtggagtctttttttttaatggaataagatcatcagaaatcctggagcaagacagactggctgtggtctaccagcattgtagtaaaaacattggggaagttttataagacctaattattagaaaataccataaaatagtcattttcatagaaaaagctttcctttctttcctcacactaaatcacattactttgtgttcaaggtaaaatggagtttgaaatctggatgtaaataagaaaagatattattttattccaagtgaaacatgtattcacacttcacgtcttgaagcaccaggtggccatttgggctgagttttcaagaaaaaaaaaattatatagattttatgtccccccccttttgttgttgctgttggtggtggtggtggtgatttttattttttggtaaagataataacatatgaaacaattttcctgttaattaaaacttactctatttatgagcatgatattttaaagaaattttttatatataatgaatatttggatatatatgtggttaatggttattttaacaaacattttggtttgctgaaatttttaagtttttttttcttttattattatactttaagctttagggtacatgtgcacattgtgcaggttagttacatacgtatacatgtgccatgctggtgcgctgcacccactaactcgtcatctagcattagataaatctcccagtgctatccctaccccctccccccaccccaccacagtccccagagtgtggtgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggccgcatagcattccatggtgtatatgtgccacattttcttaatccactctatcattgttggacatttgggttggttccaagtctttgctatcgtgaataatgccgcaataaacatacgtgtgcatgtgtctttatagcagcatgatttatagtcctatgggtatatacccagtaacgggatggctgggtcaaatgcgatttctagttctagatccctgaggaatggccacactgacttccacaatggttgaactagtttacagtcccaccaacagtgaaaaagtgttcctatttctccacatcctctccagcacctgttgtttcctgactttttaatgatcgccattctaactggtgtgagatggtatctcattgtggttttgatttgcatttctctgatgcccagtgatgatgagcattttttcatgtgtcttttggctgcataaatgtcttcttttgagaattgtctgttcatgtccttcgcccactttttgatggggttgtttgttttttcttgtaaatttgtttgagttcattgtagattctggatattagccctttgtcagatgagtaggttgcaaaaattttctcccattttgtaggttgcctgttcactctgatggtagtttcttttgttgtgcagaagctctttagtttaacgagatcccatttgtcagttctggcttttgttgccattgcttttggtgttttagacatgaagtccttgcccatgcctatgtcctgaatggtaatgcctaggttttcttccagggtttttatggttttaggtctaacgtttaagtttttaatccatgttgaattgatttttgtataaggtgtgaggaagggatccagtttcagctttctacatatggctagccagttttcctagcaccatttattaaatagggaatcctttccccattgcttgtttttctcaggtttgtcaaagatcagatagtggtagatatgcggcgttatttctgagggctctgttctgttccattgatctatatctctgttttggtaccagtaccatgctgttttggttactgcagccttgtagtatagtttgaagtcaggtagtgtgatgcctccagctttgttcttttggcttaggagtgacttggtgatgcgggctcttttttggttccatatcaactttaaagtagttttttccaattctgtgaagaaaggcattggtagcttgatggggatgacattgaatctgtaaattaccttgggcagtatggccattttcacgatattgattcttcctacccatgagcatggaatgttcttccatttgtttgtatcctcttttatttcattgagcagtggtttgtagttctcctcgaagaggtccttcacatcccttgtaagttggattcctaggtattttattctctttgaagcaattgtgaatgggagttcactcatgatttggctctctgcttgtctgttgttggtgtataagaatgcttgtgatttttgtacattgattttgtatcctgagactttgctgaagttccctatcagcttaaggagattttaggctgagacagtggggttttctagatatacaatcatgtcatctgcaaacagggtcaatttgactttctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccgtcaatacctaatttactgagagtttttagcatgaagggttgttgaattttgtcaaaggccttttctgcatctatggagataatcatgtggtttttgtctttggctctgtttatatgctggattacatttattgatttgtgtatattgaaccagccttgcatcccagggatgaagcccacttgatcatggtggataagctttttgatgtgctgctggattcgttttgccagtattttattgaggatttttgcatcagtgttcatcaaggatattggtctaaaattctcttttttggttgtgtctctgccaggctttcgtatcaggatgatgctggcctcataaaatgagttagggaggattccctctttttctattgattggaatagtttcagaaggaatggtaccagttcctccttgtacctctggtcgaattcggctgtgaatccatctggtcctggactctttttggttggtaagctattgattattgccacaatttcagatcctgttattggtctattcagagattcaacttcttcctggtttagtcttgggagagtgtatgtgtgcaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatctattttgttgatcctttcaaaaaaccagctcctggattcattaattttttgaagggttttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcattggtttcaaagaacatctttatttctgccttcatttcattatgcaccccgtagtcattcaggaggaggttgttcagtttccatgtagttgagcggttttgagtgagattcttaattctgagttctagtttgattgcactgtggtctgagagatagtttgttataatttctgttcttctacatttgctgaggagagctttacttccaagtatgtggtcagttgtggaataggtgtggtgtggtgctgaaaagaatgtatattctgttgatttggggtggagagttctgtagatgtctattaggtccacttggtgcagagctgagttcaattcctgggtatccttgttggctttctgtctcgttgatctgtctaatgttgacagtggggtgttaaagtctcccattattaatgtgtgggagtctaagtctctttgtaggtcactcaggacttgctttatgaatctgggtgctcctttgttgggtgcatatatatttaggatagttagctcttcctgttgaattgattcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacatgagatgggtttcctgaatacagctcactgatgggtcttgactctttatccaagttgccagtctgtgtcttttagttggagcatttagcccatttacatttaaggttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggcaggcctggtggtgacaaaatctctcagcatttgcttgtctgtagagtattttatttctcctttacttatgaagcttagtttgcctggatgtgaaattctgggttgaaaattcttttctttaagaatgttgaatattggcccccactctcttctggcttgtagggtgtctgccgagagatccgctgttagtgtgatgggcttccctttgagggtaacccgacctttctctctggctgcccttaacactttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaaattggttccattctccccatcactttcaggtacaccaatcagacgtagatttggtcttttcacatagtcccatatttcttggaggctttgctcatttctttttattctttttcctctaaacttcccttctcggttcatttcattaatttcatcttccatcactgataccctttcttccagttgatcgcatcggctcctgaggcttctgcattcttcacgtacttctctagccttggttttcagctccatcagctcctttaagcacttctctgtaatggttattctacttatacattcttctaaatgtttttcaaagttttcaacttctttgcctttggtttgaatgtcctcccgtagctcagagtaatttgatcgtctgaagccttcttctctcagctcgtcaaagtcatcctctctccagctttgttccgttgctagtgaggaactgtgttcctttggaggaggagaggtgctctgctttttagagtttccagtttttctgctctgtttcttccccatctttgtggttttatctacttttggactttgatgatggtgacgtccagatgggttttttgtgtggatgtcctttctgtttgttagttttccttctaacagacaggaccctcagctgcaggtctgttggagtaccctgccgtgtgaggtgtcagtatgccccttttggggagtgcctcccagttagggtgctcgggggtcaggggtcaggcacccacttgaggaggcagtctgccccttctcagatctccagctgcgtactgggagaaccactgctctcttcaaagctgtcagacagggatatttaaatctgcagaggttactgctgtctttttgtttgtctgtgccctgccctcagaggtggagcctacagaggcaggcaggcctccttgagttgtggtgggctccacccagttcaagcttcccagctgctttgtttacctaatcaagcctaggcaatggcgggtgcccctcccccagccttgctgccaccttgcagtttgatctcagactgctgtgctagcaatcagcgagattccgttggggtaggaccctccgagccagatgcaggatataatctcctggtgtgccgttttttaagcccgtcggaaacacgcagtattcgggtgggtgtgacccgattttccaggtgctgtccgtcacccctttctttgactaggaaagggaactccctgaccccttgcacttcccgagtgaggcaatgcctcaccctgcttcgggtcgcgcacggtgcacgcacccactgagctgcgcccactgtctggcactccctagtgagatgaacctggtacctcagatggaaatgcagaaatcacccgtcttctgcgtcgctcactctgggagctgtagaccggagctgttcctattcggccatcttggctcctcctctcaaatcagatttctgatccaatatttcaagttttaattttcccactggtaggctctattcctactctttttctgctcatggctgaaaattttctgtatctcccatctctttcatatttgaatctattgaatacatagcctccacactcttaataaaatactaatttcatcatgtaacttcattattcaaaatatttagtggctcccactacctatattaaagattccaaactcagtagttactaatatttttcataggctttctagtcctgtcctttcttttagtcttatctcttactactttaagcttattcctagggcaaacatcttactatttccaaaatgtgattcaacgtcattcctattgcctaggaagacactcttctgtcctatggctctctaagtctacttcctgttgaagtactctttttcataaacattcaaattgtttttgtgtcctactttggtgttacctgacatattttaaaactcatggattggatcacatatctatgcatttacttatggcaccattacattttatttattttaagagacaagatattactcttttgcccaggctggagtgcactagcacagtcgtagcttaccacaggcctccaactcctgagtcaagtgatccttctagctcagcctcctgagtaactagaattgcaggtgtacaacacaatgcagaggtacatttaaacaattttttattgttattttgtagagacagggtcttgcttcattgccccggttggtctcaaactcctggcctcaagcgatcctcctgcctcagcctccgaaaatgctgagattaggaatgtgaaccattgtgcctggcccacgttacattttaacagtggggatctgaacactgcagtttcccaaagccaaaaacatgactaactcagctataaatatttaaccaactcttaagtatacctcctggaccatggtcatatagagcagaggctgtgctactatatatgctttagttttgctagtacatttagaaaattgtttattacatagtcagtactatggtgaatggttaagatatgttgaatgccctgctgagacaacgtttttactttgataggaaagtcaaaagaataacacacatatttaattattaaagaaccagaacatgtagttttctgaatttcttagtataaaaagctccttaagagacataagtatacaaatatacacttcttcatctatgatactctattaaatttggcatatttctttttaacaaaaacttacaagggtagaaatctgctgagatgatatatgaaatgtggaaatgttaaagatagattgggggggtggttaagataagacattgaagcatataatactcctcttggagaatcattcagcttgccaagctaccatgaatcagtgtttgaaaagaggcagaagatacatacatagaaaaatcagccaaaatattcattaacatgaaatgtttccaaagctgaagtgctacattaatggttgactttgtgcctcaagactaaatattgggcaatgttagctttccctataataaaacttgccccaaaatatatgttgagtatcccttatccaaaatgcttgggaccagaagtgttttggattttggatattttcagtttggaatatctttattatacatacgagttgagcatccataatctgaaaatctgaaatccgaaatgattcaataaggatttcccttaaaaatgatcgtgtagttactcaaaaaattacagattttgtagcatttcagatttcaaattttcctattagggatgttcaacctgtattgaacttacttgcttacacgtgttgcccgtttgctgtactgtaagctctgtgaaaaaagtatctgctgacttctttgttcataattgcgccctagcaccttttgtggtagttggaaaatggtagacactgagtaaatatttactaaatgagtggataggtaaaagtatttcagtttggcatggcaagatggaaagactaacagtgtttaagtggctatggccaacgtcaggccttcttcagtttaagaactgtggaaagaagaaaattaaacaattaaggaaagataagaataaatccaacaggaagttctcactgaagccaagagattcaaaaaaatacaggaagaagaagaggaagaaaatactattttctatgcattatattcccaaagatatctgccttactgattaatatcaattaataccataactatcacattttctcataggccaaggtgaaatgtctgataagacaagctttgttgctaacacaatttaactcactttagaatattaacatgacatttatgtggtctactcctctctaagctcaaataaagcagctgcgtataaaaagcagccatggattaaatgacttcagcctgctttgtggaaactactgctgttaaacctgctcttgataaactacaaagagtgcctggactccatttatgaaaagacatttgaatatagacctcacatggtgatcatttaaaaatattatattttgcctgtattacaacattgggttgtatttttgtttaaatctctacttcatttacttatgcgtgtaatactgacttgcttcacaaaatgttactctggagtgtctggcaagcttcctaacaagaaatttgaaagcagttttacatgaaaatcacatttttgaattttatatttctagacaagttttagtacaagcagtgtaagagcataagagtagtctatgtcatatgctatttgtcagtctccaatgaagagtaaacatttatcagcttcagtaacaatccctgcctaactgaggagtgtcattttctgaaaatattgattgatagaggccttgcctaaaaaatataaaatgcatgtaatttacacacagctgagaaatacaagctcattttttcctgacaagcagtaatgccctttataaactatggagattaaattacaaaaaaagttaaattaaaaacaaaagtatgatcagagtgatcagagttttgtgtggtacattttctagtaatcatgttttacagcagtctaatttggtaaataaaagtgaattggaatatattttaaaggctaatatgtatatgtgtgtatgtgtatgtatatacatgtatatgtgtgtatatatacatcatagaaacctttatatttaagagaaaatcatcaacaaatacttttaacacatttgttgttatgacgcagtaacatgtatcctaaattaggaaagtcatgtttccggatattttcctaaggaaatattggttctaaaaattcagcataggaacgtcaagtattttattattcactgaagggaccaataatatcaatgcaagcagaggcctgatatagaaaaattaattaaggtgattatagaggtgtaagcaggactctagtaaatgaatttagaaggtggtctagtcagttgcttgaacattaatcagaatttagagttctgctctgttataaactcaatggtctcgtgaaaccatttttatacaagtctcaatgaattcatctctatatagttcttgttccacctactttagtattttttgaggagcaaatgagataatgtgtgcgaacataagacacaatgtgtaatctaagccaatctgggcagattaccttctctagtgcagattagagatatctatgcattcactaactgaatttttgtaccagttggaagtgtttctgaagcagatcttttttttgctagtctattataattattaaagatgatatcatgcctaaaatttgtcacattaaagaagcatcagtatctttgtaacattcacacattgattttacttcaacctagaggaaccatgactgcctttaaccatttgaaaaggtctttatgaatctaccatctccaagatgaatacccacagcctttattattgggctcacttttggtgtcctttatcgtcatggtagtcatagctcctacatctagtaaacgttaggcctagaatttgaattgccttgattctcaaataatatctgaatccatcatcttatatatttataatttctttgaatatgtgataattaattcagggtaattagcacatccaatgtctgtgtgtagaaacattgtgttggaccccataaatatgtataattatcatgtcagtcataaataataaaaaaaacttcccacaaataatttataaacccatgcagtccttataactgctctttccaatattaatttcagacttaaaggtgatctgttaaattttatcttactggtttcgatattattatagctaagacatccatagctgaattttattacaaagagtaaaagctaccctttccaggagagtaaaatattttattataatagctgtatttttatgccttaagatccaagatcattggcaaggtatatttggtggaagcagtccaaatgagagtcacatgaccatcaagtagatataactttaaactgacacaaggccatttgccatcactttttggatagggtgtgctgccacatgtgtgtttttaaaatactatattttagtacagattcaaaattttgtctgtgaatttattatgggagacattgataagctacattgtgaatatgaccttatctatcgaactaataatatgatcaaaagagaaaatgacatttgttcatgggttgatttgctaaccccgcagtgtcataaatagtttatagtagtgtcattgcctccatagaaagttaagattgcgtagattcttcagctgtaataaatttgtaacatatatattggataaaagtatatgagaatgttcaaaacattatttagattaagagatatacctattagaaattgcatatattccaggggaattttttaaatttttgtgggtacatagtttgtatgtgtatatatgtatagaaagagagagacagtacatgagatactttgataaaggcatgcagtaaataataatcacatggagaatggggtatccatccactcaagcatttatcctttgtgttataaacaatccaatgatactgagttattataaaatgtacagttaaattattgagtatagtcaccttgctgtgctcgcaaatactatgttttattctttctaaggaatttttgtacccattaaccaaccccagcttacctccaccccctagtaccctactcagcctttgagttgagatctctctctctctttagctctaataatatttgctttatttatctgggtgctccagtgttgggtgcctaaatatttgcaattgttgtatccttttgctgaattgacccctttctcattatataatgaccttttttgactctttgtttttgtcttgaaatctgttctgtctgaaaaaagtacagccactcctgctgttttttggtttccattggcatggaatatcttttttcatccattttcagcccatgtgtatctttataggcggtcattaaagatgtcaagtattttgtagaatcatagcatgtatataaacacatgcatgcatatacatatatatacctatggactacaatattatagataaaatttcataagtgactatgatccatgatatgagaggcagagaatgctcagcagtgggatccctctctcaagccatactgtcaaatctagtatattgaaatttctggaacacccttatatattagagtctttaccagaaatgctggtacgtttattttaactgttattgcagaaatggctaagaaaacaatgtctagattctaaagcaaggattaggattgtatactttcttctgttgtgttacacagatacaaccaaacaatgactatttattaagtactatctgtggctaaggtgttgtacttgaggctgtgttatttacgcactaagctgttaaagtttatttgatgtttactagagctttctgatgccaagaacacaactctggttttggtagctctcttttttccattgtttaaaaatgctaaagatcatgcaaataattaacatatgataaacattttttaatctcagtaacattgtaaatttataatatgatgagaaaaagagctgaaagattactgatgtaatttataacaggttagtatttttagttcatcattataaacccagaagagaagagctaataaagttattcagttgtgcttatgtaaatcttttggatcttgagacttatttaatgactggatgaagattttaagtgccatgggatatgtgagctacatggttcaactgtacaattggatcactgttcattttatgggctgtgatatacttcacattgggttgatttattgtttcagagtaaaattagctttaacatgttttcttcctaactgaattgtaaatcaattatgttaacagctcctcttggtaagggcctagacaaaatacatatggtcaataaccattttgtgtgaaataagcatataaaaagcagactttagtagactactctagatttgcatagttcctcataaatcaactttatgaaaatgataagaactgaacagaaatttatttgaagaatttgagccataacagccttataaattaggttcacttcacctattttattcacctcgtttagtttcagcaaaaaagtctgatttaatttagagtttattattacttttgattttaaatgcacaattcttaattgtatatttatacattccagttggaccaattttttgaaaggatttcctcaagaagtagaattgcaccatttaaatgtattatatttgacttgtcaactgtcgaatctaattgtcatcatttgaaatacaacaatatgtgctaattattttagttttagtttttattcttttactggatgtacttaaggcaaccttgtccaactcacagcccatgggctacatgtggcccaggacagctttgaatgcagcctaactgtaattcacccactttcttaaaacattatgagatttttttgcaggtttttttttttagttgattagctattgttagtgttagtgtattttaggtgtggcctaagataattattcttcaaatggagcctaaggaagccaaaagattacatacccctgatttaaggggtacaagatgttacgatatacatagacataatgaaatgattactgaattcaaccaaattatcctatccattatcttccataataactgttttggtatggtaagaatacctaaagtctcttttcttagctaatgttcagtgtacaatacaatgccattaactgtagtcatcatactaagcagttatcgagatttatttatccaatataacttcaagtttgtgtcctttgacctacttctcctcatttcttccaaacatttaaagagtaatttataccatttgttcttaaaatcttctaaataatagaagaggaaatacctccaaagccatttatgacttcagcatcaccctaaatacgaaagtcaaacagacaccgcaagagaagaaaatatatatatgccaatatctaggaggaatatagatgtgaaagtcctcaataaagtattagcaagacaaataacacattggattataaaccgtgaccaggtgggtttagccctaggacacaaggttggtttaacatacacaaatcaatcaatgcgacatactacattaacagaaagatgaaaaaccacatgattatctcaatacatgcagaaaaagcatttgataaagctaaacatccttttattattataactcttcgcaaaatatgtatggaaggaaatttcctcaacatcaaggctatttatgaaaagcctatagctaatatgatcaacggtggttgtggggtggttgtactgaaagctttccccttaagatttgctaaaaagcaaggatgcccactcttaccacttccatttgtcatagtaccaaaaatactagcaggagcagtgagacaaaattaataaaaggctttcacatctgaaaggaagaagtaatattatttctgtttgcaaatggtatgatcgtatatgtagaaacccctaaggactccacaagaaaaatgttagaactaataaatgagttcagtaagtagtggaatacaaaatcaacataaaattagttgcatttttatgcaaaagatatccaaaaaattttaaaaaattctatttatgataacatagaataaaatatttaagacccaatttaaagaagaaagtgaaaaatacgtacaaccaaaactataaaacattgaggaacaaattaaaaggtaaatatatgggaaaatatcccatgtttgtagactggaagaagtaatattgttaaaatttccatactacccaaatggatatatagctgtcccttggtatccacgggacatgggttccaggatgccagtggataccaaaatccaaagatgcttaaatcccttatacaaaatggcatagtatttgcatatacctatgcacacccccctatatactttaaaacatctatcgattatttgttattacacctaatacaatgtaaatgctatagaaatagttgttaccatatattatttttacttgtattaatattttttgttgttgtattgagttttttgttctatttttgattatttctggtctacagttgcatccgtggaaatagaaggttgactgtacaaatttaatgtaatccctgtgaaaatctaaatggcattttttttcacagaaataaaagagcattataaaacttacatgaaatcccaaatagccagaacaatcttgaggaaaaaaaagttggaaatactgctctttggatttgaaattatatcataaatctacagtattaaaaagagtattgtaatgccataaaaacagacacataaactgatggaacagaatagagatctcacaaataaacctaagcctatataatcaactaattttggacaggaccaccaagaagatatgtggggaaaggacagtctcttcaataaatggtgttgtaaattgtacccttgtcttatactgtacacaaaaattaagtgaaaatggactaaagacttaaatataagacctaaaatcataagactcctagaagaaaacagagaggaaaaagctctctgacagtcgcctttgcaaggattttttgaatatcacatcaaaatttcaggcaagaaaacaaaaataaactagtggaactacattaatctaaaaagcttctggaaagcaaaagaaaaacacagcctacagattatgagtagatatttgcaaaacatatatctgataagggtttaatatccaaaatatataaggaacttgcacaattccatagtgacaaactaaataacccaattaaaaaattgggaaagaacttgaacattttttttttcaaagaagatgtgcaaacggccaacagggaaattaaaacgtgctcaatatcactattagggaaatgcaaatcaaaatcataataaggtattacttcatacctgttaggatgagtattatctaaaagatgagataacaagtgccagtaaaggcaaggaggaaagggaaccctgacatactgctggtgtcggtgtaaattagagcagacattatggaaaattgtctgggagtgtttcctcaaaaagttaaaaatagaactaccatatgacccaacaatcccactcctgggtatagacccacagaaaatgaaatcagaaccttgtggagatagccttactctcatgttcattgcgttatgattcataatagccaagatatgaaaataacctgagtgtccactgacagataaagaaattgtgacacacacacacacacacacaaatattcagcctcacaaaagatagtgccatttgtaacaacataggtgagcctgaaggaaattacactaagtgaaataagcaagacacagaaaaaaatatgctacgttatctaacatctgaaatctgaagaaaatgtataagttgaatacatagacagtagaatggtgattaccaggagtagtgagggtgaggaaataagtcaatgtgtacatggaaacttgcagttatgtgggataaataaatttagagtttcgatatacagctaacccttttttaaaaaaatataaaagcagataataatggggtaaaatgtagtgttttgatctatgcatacattatgagaaagatttgatctagctagttaaaatgtctatcgcctcagctacttaaccctttctaatatttatctaaaatatgtcagatccagagatgtatgaccagattttaacatcatttttaatgtagaattgacagttgtaacaatgattttctcagtttgcttattcaacacccatggaccaagataataaatttaggacctatttaagtagtttctaaaaaggcgttaaaaaaatccccatgggggcaaacaatgtgaatcgaataacatttccaaatgaatgtaatttgctcatttggatgtgagctaagtaaaaaaacgattgtaaaagaaaatgtaagtaatagaaattatctaagaagagcaatgagatgtgttccatctgtgaccaattttggtcaattttttcacaggcatttaatgggtgcaaaatgagccagtcttggtattagaccgttaaaatgcattgtcttctaggagttcatattgtttcccctcccattctgaaaaaaattagaaaaggtaacaacaataaagaattgtggtagacaaaaactcttttgtaaggtatgatttgactcgtataataggtgttacgagtgttgagtggctctgtcagatagaaacagtcaaagaaatgctagtaatgttgtcttgtttgctttacttgtaagtatcttgtgtattttatttacttaatatatttaatttactttaatattaaaacgtgtgtgtgtgtatatatatatatatatatgaatgaatgaattctaatgggtcaggtcatatagtatgtgtgtgcacgtgtgcacatgcaagctgggataacaacgtattatatgatagagtctatctggtgataaacgttcagaggttggaaaagggcattgtgtaccaagctcttgaggtattctgggaaataactgcacaccaagcatttggatattgactgactgataacagtaaatgtacatttattcagctaaataaatgaaaaaaaaagtatcaggcattccaagcagtgaaaataacttaaataagaacacaaaagtaagtctacatttaatatgctcaaagcatcatgtgcatctgtacaatatccaaaatatttccaccagaattaaattttgttattccattattttactataatatttggaggcaaatgcatattaacataatcagtttaaactttgcaatactaaggtttctcttttatttagtacaatgacccaaagttatagaattatttgcctctgatttcttggcaacatatgtatactttactgaaaatttcatctacttcattcttcatcaccctacactcacacagagaaacaaattgataatgagaaattgaaaaggaatatgaaagctcagtgctgatttttatttggttcatgtaaacctctagaagcttagctctattaagattatctgaacctttgtaatactttctatttgaagctatttgcttccaaccagtctatcttatattaattattattttcaattcatcagattatgtggatgcaatggctgataagttgagatatactttgaggaacactgctatgataatcatgatagaggatgcatgggtgattcatagtatttccaactatgtccagttatgtttagtgtttgtgaatcacctatttgcctaccttctctagttgagtaactatatatgtaggtaattgaatcagactattttgctaccaagaatatagcctcttccccgatataaagaggcaccaattacagattatttacctaatggagcattttaaatatggaaggttattaactatttacacttgagtcaacattggaataaaaagttttagctgacaaaattatttgctaagtgtgtacttccatccacatttgccatatattttaaagagcaataaggaaagtcttttaaagtgatgaaattcagggctttcatttaattgatgtttttatgtgacatatttatattaataataaaatgcaaaacagtgaacaggtaatatttaatctttgttcttccttttcttaaagtcaggaagccagaactagtcagtcctatcagtaaaagcaaaagtaatatatccaatgacatttgcttaaatacattaccaagtcctgagaaaggttcttactaatctgggaataaatgtccttatcttgatatgtgtattagtccgttctcacattgctataaacaactacctgtgactgggtaatttataaagaaaagaggcttaattgacttgcagttccacaggctgtatgggaagcatggctggggaggtctcaggaaatcactgtggaaggtgaaggggaagtaggcacggcttacatggccagagaaggaggaagagagagcaggcagagatgctacacgctttcacacaaccagatatcatgagaactcactatcattggaacagtaagagggaaatctgcccctatgattcagtcacctcccaccaggcgcctcattcaatattggggatcacaatacaacatgagatttgggcagggacacagtgccaaactatatcgttctgccccaacccctcccaaatctcatattgttctcacatttcaaaatacaatcatgctttcccaacagttccccaaagtcttaactcattccagtattagttcaaaagtccacagtccaaagtctcatctgagactaaggcaagtcccttcaacctatgatcctgtaaaatcaaaatgagttacttccaagatacaatgagggtacaggcattagctcaaaagagttaaatcgatcagaagaaaggggttacaggccctgtgcaagtccaaaacccagcagggtagtcattaaatcttaaagctccaaaataatttcctttgactccacatctcatccaagccacagtgatgcaagggacaggctcccaaggccttgggcatctccatccctgtggctcagcagggtgtacagcacccttagttgttttcatgggctggcattgagtgactggggcttttccaggtgtatggtgcaaactgtcactggagagaccattctaggctctggaggacagtggccctcttctcaaagctcaagtaggcagtgccccagtggggactctgtgtgagagctctaaccccacattacccttctgcactgccctagtagaggttctctatgcaggctcccccgctgcagcagacttctacctggacatgcaggtgtttccacacattctctgaaatctaggtggatgctctcaagcctcaactctcacactctgcacacttgcaggattaacaccacatggaagccaccaatgcttatggcttgcaccctctgaagcaacaccccaagacacatctggggcctttttagtaacagctggagctggagtgtctgggacatagggagcagtgtcttgaggttgtgcagagcagtgaggccctaggcctggcctccgaaatcatttttccttcctagacctccagacctgtgataggaggggctgctgcaaagggttctgaaatgcctttgggcattttcccctttgtcttggttattaacattcagttcctttttacttatgcaaatttccgcagacagcttgaatttcccccaccaccccgagaaaataggcttttgttttctaccacatggtcaggctgcaaattttctaaacttttatgctctgcttcccttttaaatataagttccagtttcagataatctctttgctcatacatatgaccgtatactgttagaagaagccaggtcacatcttaaatgttttgctggttagaaatttcttctaccatataccctaaatcatcagtctcaagttaaaagttccacacatacctagagcaggggcacaatgctgccaatctctttttgttaaagcattgcgagagtgacctttattgcagttcccaataagttcctcatcttcatctgagaccacctcagcctggatctcattgtccatatcaatatcagcattttggtccaagcagttcaagtctctaggaagttacaaactttccctcatcttcctgtcttctgagcgctccacactgttccaacgtgtgcttcttactctgttccaaagttagttccacgttctcatgtatcttcgtagcagtgccctacctctcggtaccaattttctgtattagtcctttctcgcattgctataaactacctgagattgagtaatttgtaaagataagaggtttacttaactcaaagttcttcaggctgtacaggaagtatggctggggatacctcaggaaatttccaccttcttgtggaaggcgaaggggaagcaggcacatcttataccttacatggccagagaaggaggagaaagcagggggcagtactacacacttttaaacaaccagatctcatgagaactcattatcatgagaacagcaactgggaaattcaccctcatgatcctatcatctcccaccaggcccctcctccaacactggggaacacaactcaacatgagatttgggcaaggaaacaaatccaaatcatatcaatatgctagaatgactcaaacaataaatacgacaagaatattcctcctctgtattgacgctgttcagtatttttctggagaacctagccaatattatatgacgagagaaagttacatgaaatatatattggaaagcacaagataaattatttgaaaataatatgattttctcattatgtaaaatgatctcaaaattaggaaatgtacagtggtaataaaatgatactcagcatagttactttttgtttttcagtttccacaaacaagtgagatcatgcaatatttttctttctgtgtcttgcttatttcacttagcctaatgttcttcggctccatctgtcctgtggcaaataagaagatctcctttttttgtgtttctgttttgagatgaagtctcactctgccactcaagctggagtgcagtggctcactgcaacctccacctccccggttcaagtgattatcctacctcagcctcccaagtagctgggatttacaggcgcccaccaccacacccagctaatttttgcatttttagtagagatggggtttcaccatgttggccagggtctcaaactcctgacctcaggtgatctgcgtatctgcctgccatggcctccctaagtccctaagtgctaggattataggcataagccaccacacctggtcaagatctccttttttttttttttttttttttttttgatggaatctctgtcaccaggctgatgtgcagtggcacaatctcggctcactgcaacctccacttcctggctttaagagattctcctgcctcagcctcctgaatagctgggattacaggcgcacaccaccaagccaaactaatttttgaatttttagtagtgattggcttttaccatgttggccaggatggtctcaatctcttgaccttgtgatcctcctgccttggcctcccaaagtgctgggattacaggcatgagccaccacgcctggcccaagatctcctttttaaaggccaagtaatattccattgtgtataactatatagagagaataaaacagtggttaccaggttgggggtggaaggaggaaatggggagatgtaggtcaaagtctataaagtagcaaatatgtgggataaacaagttgaaagatctaatataaaacatgaggattatagttaatagtgtgttgtattcagaatttttactaaatgagtagattatagcttctcgtggtcagagggtgggggaacgattatgtgagatgatggatatgttaatttctttcattatggtttcattatggtaaccatttacatgtgtatcttatagcatcatgtgtataccttaaaacacacaataaaattatttttaaaaaagagaagttccaaaatctatgtagttttcttagaagtaaaccgcacaagaaagtataagcttttttttataggaagtttaaagttgtatataagtacataaataaagacatgaggaaaggaagtcacatatgatgaaaatgctagttctccctaagttagtttgtacattgaaagtaacttcagtcacactcgcatgttcactggagcactatgcgtaatagcaaaatcgtggaatcaagttgtgtccatgagtagataaagataatgtggtgtgtatatataatggaatactaacgagccacaaaggaataaaattatgtcttttgcagcaacatggatgaaactggaggctatcatcctaagtgaaataagtcagaaacagaaaatcaaatactgtattttcctataagtggtaactaatcaatgggtacacatggacatacagaattgaatactcaacattggagactccaaaagatgggagagtgggaagggggtgagagatgaaaaattacctattaggtacattgtagactatttgtgtgatgggtacactaaaagccgagacttgatcactacacaacatatccatgtaacaaaattgcacttgtaccccttaaatctaaagttcctgaagttacttcaatcaagatctagatggtccctgacttaagatggtttgactaatgatttttcaactttatgatggtgtgaaagcagtgtgcgttcagtagaaaccgtactttgagtacccatttaatcatgccatttttcactgtcactactgtgctcaatgcattacacgatatattcagtactttagtttttatagaacaggctttgtgttagatggttttgccaaagtataggctaatgtaagtgttcttgcatgtttaaggaaggctaggctaagctataatatttgacaggttcagtgtattaaatgcaattttgactcactatattttctatggacaatgggtttattggaatgtaaccctgtcataagtcgaggagcatctgtataattacacactcacatgcccacaaacatgtatgtatgcgactctctgtgtatctatatttgtattattttagaggatataacagaaccctagcaataaatagaatttatctcagatggtaaaatgaagataattgtattttaaaagttacagaagtatatattaacaaataggtgacaagaaataatctagagaggagcaatagtaggaagtagttactatttctactattcctactatatagtagctgaaaggaaagggggaacggagttcagtgaaagctgcaccaatggagggaatgtagttgttggtagaactcagatactacattatgcagctctggagcagggaaataatagagaaatttccccagctttctctttccctcttctttcaatctccagctggtacttcccaccagcttaatgcaactggaatctagccagctaatgatcacaggagatacagtgtgaaagggtcagccacttagagaataagcagagaagaaagggtgtttatgttcagggtgagcacactgaacataaatcacatgaatggtaagagggattcagttttctagataattctaaaatttgtttaaatgtaaatgcgtgagtacagttaagaaattattttcaaacaggtgatttgctttagtagattttataacatacttaacatagtatgacatgatagagaaataatttaatggtgtggaatagatattttgacaacattcccttttatttaggtaaatttagtacacaattagggtgacatttcatgtctctagagatagaataggttagctaataaagccttcaactgtggaaacccaaggcacaacaaatactaagataactttcagataatgattgaatgtgaataaacatttaaatactttattacaatgtagaagaatattacaataatattaaggtgatataaaacctagaggctgtaaaataccgacaaatttaccaacacaaaattaaaatattttccattgtgaaagaccattaaacagtaataaaacctatgatggactgcagaatgacactagtaataaaaaatcaataacctcagtatgataacactcctacaatgaatatacaaagtataatattttaaaagtggctacatattatggtcaggacattcacttgggaaaattagaaatagcccatcaaaataaaattaagcttaactaataaataaatgcatagtacaaatatcttcttattatgagggttcatgtaaataggccctgtgtttcttttggaggaaacacaacttgtaatattttaatcagacaatttagtattatctttcaaaatatgtaattttacatatatttgatcctgaggtttcacatttaagaattagatatatagtaatactcatacatatctacgacaaatgtgtaaggatgttcattgcagcgttgtacacagtagctccagtatttttcatgctatggactgttaggcagatatatctctaccattggactataggcaccataaaatcagggtctaggtttgtttgtgtttgtttttatttttgctcactatttcagctgcagtgtccagcataatcctcgacttatggcaagtgtccaataaatagttacagaataaataaatggataaatgaatacatgcattactgaaattaattttgaagttcacattgtatatatacatgtgtatatacattttaaacttgaaatttgctgaaaacatactttatgccaggcattgctctaaatgccttacttgcacttaccttcttggaaaagtctttgcctcattttaccaatgagggtatgaagaaatgaagaaattaagtttcttatccaaattcataataccagtgagtggtaaagctaaattttgaatctttactaattgagcacatcttaagaaagtacatgcatagacagtgtatatgtttaatctcattagacaggcagatgagtatgataaatggatagctaaaagaatggctgaatggatagatgcatggatgtatggatgacatagcatctggtgacaagtattacttctagctaatgggactgtggtgctgtagagatatggggtactttcactattaactttaaatgcgtctgtactgttttagttttccactacaataagcatgtatggcttttgtaataaaatgtttaaaagtgagagattaaatccagacttatgaaattaaaatatcaaagacaactaacggttgaactcttggggccaaaaccgtcaatgggatgtgttttctctgagggaaagctttcctaatcaaggggcacgttcccattgagataagagtggaaatgacccatctggtcaatccaagatcagagcccatatggggactggagctatgataaggagtcaggctccataggatatagtaattgagatagttataccaagcccctgggtttctggtcatcaggaaagacaggcccctgctagtagagctctacctgagggagaggtatttgagagaggccgacatttcagagtcaagaagaactggaagctataccaagaaaatgggttatgtggtatttagcatatcagttttaaccctcatccagccactgagaaaaggaaagaagaaattttaaaattgcaaatggacaaaaggaacattcagtaattaaaatagcagtaagattctacgcaaagcctttccttttctctatttagtctttgaagttgctaatatctagtcaaagggagttgctttccaaatatgtaatgtttgcatgcatattatagttatatattagtgatcatattgtttataaatgtgtgtataccatcctaggtttttgtttctttattgaatccctttctcatatatctgagcttaaaaagcattttttacaattatcattatttggtagaatcctacccaccgctgactcatagttttagtgagatgacaaggaattcacacacttgaatctttcaaacccccaggtatgcagacgcttagcacaaaatttttggaagctatgcttccaaagttctaaggagtctgcttttcctatcctcagtctgagagcacttgagtacatttttttttctgtagatatcagtcaatattatttttgaaaatacgtttttgtaaagcacggtgctattttgtagtgtgtatgccaaagtttagaacaatgaataaaacattagttttcctgtgtcttgagtattttcaatctgaatttaaaatgtactaactttgtcatcatcactcataggcttcttgattaacctgctaatgctctctaatttggaaattaatgcttctttccctatcacttaaaaataatctgatacagtttctagagcatgagatgttcttcaaatcaagtcttatttttggaaatgtgatcaataagaaaaacttcttgcaatacaataggaagctgaggtgcattatgcttaactttatccaaggtcacaaaatgaaagaactgggagccaaaccaaggactctacttttttttttccactttaatcagactgtcacttattggttgtatgaccttgggctgtattcttaactcacaagagagtggtgaatttaaatgaaaaaaaaacataataaaagttcttgtatataattgatacttgataaaaactaattctataccaaactgaatctcttttgcagaattttgtagggagaaaaatacaggctgctcctgttccttgctatgtgctttctgccccttcaagcagtgctcaattttcaacatgtgtcttactctacattcagggggtgtagaccatgaaaatgaacctttattcccaaaaggttctctctccattcatttactgatttaacaaatactgagtacctactacttctcagtcattggtaaaacaatctaaaggaagttcctgcctttgtggtttttatattcttatataaaaaataaacataataatgacagtttgtgacaagcaatgtaaaggaaatcaatgtaaaataaagggaaaggggttgggcttctttaaatgggataggaaatgcatctctgaagaggtgccatatgagttaagacctaatgggtgagaatgaatcaaaaatgcaaaaagagaaattattttaggtaaaagagcaccaaatatgaagatcaagaggtgtaaaatggccttcggtatttgagatgcaaaaacaaaacaagaccaatgtgtgaaagagaaagagggatgacattagagtgcttttagctaagtgtgaaggattgggtcatgctgtactttacaggcatggaaggcagtgtcttttaacacatacatcaaattctattcactattcaaaaaatatactttagtatatacattttaatgaaaatcaatctcagctatgttttacgcattcttaacatcatttattacattctcttttataaagttatcccttatcatcatcatatttgtgttacatggttttggatgcttactctctttttcacttgtacctttctccatcaatgcttcacatttgattatcttcacttctgtaaatttctaaattgcatttttttcacattggaaattacttgacatccatggatattattgtatttgtagttgggaggtcctaattacaatggtggaagccagaaactccaaactcaaatgaaatttcataagtactgtcaaaaggaaaatgtatctttgtaatttgaaaatgggttaaagtttgctacttcttgattgggtgtgtttcatcagcatgcctccagtagtgcttagaaaatacacaaatgcgtgatgttcgtccactggtttcagttttcagttagagtactactgaaaactttggattagttcaggaaaacttaattcgccatcagttattttgtcagttgttgaagtttgtgtgtgatggtgttttgctcaacactgaaccccttattctgatgttgcgtatgacatatgataccaccatgacaccatcccacataaatgttttgtgctgagagagtcacatcagtgttgtatgccatctggtttgtccaatggtccactcgtttcttccttaggaattaggaaatggagccattctaattataaaacgtgattaattgcttggtgaattggtatcatgtctgacacatggtaggcattccacaaatacttaatgaaggcatgaatgcaagcaaacctatgaattacaattatgtgccaattggaaggaaatcaggaaaaataatagatcgtatatattgagcatttactttgcattcattttctctgttaacatcatccctaattatttgcaagatactaatatgactcattttatagataaaaactgggacagggaaattagtgaattttaccacagtcccttacctattagtgatagggtcaggatttgatcaaggtatttttgcctcaacaggctaagctcttttatatgtagtgggtccatttttaccatatttttttcaaaaaaaaaaaaacctgatcattttgtacaatatctgcgttaagctagtcatcattgagtaatttgccccaggactgcccttataccatcaggcatattttgaaatcccaaaatataccagaaagaataataaccaattaaatttatgtcacatgaaataaacatctttattctggcctcactgtgtatcaagtataacttctaacactgtaaacaattaaggttcacaaatagactattttatgttagcgaggaagataaggggtggagttacttctgaaactgactatactttttctagcagcagaggaaagaaaaagtcaatttggttaggtcaaaagcaaagcacgaaaaccgcaggtgacaatcacttaagcagagttaaatgtcactgagtcaaaatactttcatctcaaatgtaaaccctaatagttcttcccacaacaggcatgtcgagagaattgtaagaaagtacagatgtttttctatctgtagtctcccatgctgactgagtagcttccatttgttatgtcaagttagtgtctgttctcctgggtttagaagttacataccaaatatttgttctaaggatttaaatagtcaaggatgtatttttcaaataaaatatatttaacatatgtaaacttaggacaattgtgacggaagagacaattttgaaaatttcctgcatttggaaattgaaaatttaaagatagaacttttcctgttgattagggcacacggcagaaatttgatttttgaaaaacttttcaactgaaacacgtcttatttaaaactcctaaagtcacagttggttgcgaattttcatttaactgacttttccccaccagcttctgtgcatttgctctgaggcactctcaggatgtttggtattaacactgcagagcttccattctgatttaatttccaaaaactatcccagcgaagagggcttttatggaaggcaattcaatgaagcagggatacagtggcaagtggtaaactgagaattttgaaattatttattcgtaacttcctttcccattacagtcattctttcatgagaacatatctctgggatcatttatttaccattgtattattaaagtctaaaatatagcctggcacaaagtaactcaataaacgtttgtggagtatatttttctgtgtctcatattttcaatatagatttttttttaccccctccgagacggagtcttgctctgtttcccaggctggagtacagtggcgtgatctcggctcaccgtcatctctgcctcccgggttcaagcaattctcctgcctcagcctcccgagtaggtgggattacaggcatgcaccaccatacccggctgatttttgtatttttaatagagacggggtttcaccatcttggccaggctggtctctgaactcctgacctcaggtgatccgcccacctcagcctcccaaagtgctcggattacaggcatgagccaccatgcccagccatagtttttacaatcactatcattacttccagctaccattatttactggattggctgcatgataagttccatttgtattggtaggtttaggatttattgattaacagaacgctcaaatagttttcagtgtatcagtcttctaaaagcatctgattttccttttttccctgttatgctctaggcaagcattatgcattttgagccactgtttttttcttttttaattttttgtttgtttgttttttgagatggagtctcactctctcacccagggtggagtgcagtggcccgatctcagcttgctgcaacctcctcctccctggttcaagcgattctctaacctcagcctcccgaatagctgggatcacctgggattagaggcgtgtatcaccatgcccagctaatttttacattttttttttattattatactttaagttttagggtacatgtgcacaacgtgcaggtttgttacatatgtatacatgtgccatgttggtgtgctgcacccattaactcgtcatttcgcattaggtatatctcctaatgctatccctcccccctccccactccccccaccccacaacaggccccggtgtgtgatgttccccttcctgtgtccaagtgttctcttttttcagttcccacctctgagtgagaacatgcagtgtttggttttttgtccttgtgatagtttgctgagaatgatggtttccagcttcatccatgtccctacaaaggacatgaactcatccttttttatgactgcatagtattccatggtgcatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatacccagtaatgggatggctggctcaaatggtatttctagttctagatccctgagacatttattcagccaaaaaacacatgaaaaaatgctcatcatcactggccatcagagaaatgcaaatcaaaaccacaatgagataccatctcacaccagttagaatggcgatcattaaaaagtcaggaaacaacaggtgccggagaggatgtggagaaatttttatatttttagttgagacggcttttcaccgtgttggccaggctggtgtcaaattcctaacctcaggcgatgcacctgcctcgtcctcccgaagtgctgggattacaggcatgagctaaagcgcccagcctgagccactgttttctacttgtaacaagatgatggtgatagttttctgctagttacaccataagcatgttgaaaagcgtaatggaaagtgcaaaagataaaattgttttgtgtttctcctggataaatataggccattactttttatcgttattaattttatgatgaaattcaatcatcttcatcaacgcaaattatttccattatgacattttaccgtcctttaatgagaagcattgttactaaatggtaaaagcaactgcttgtatcagtgaatgaagtgctaaaaatggattaattaaggagtacttaatttagctaaggcagaacatatcttgcagaatgttaaaaaatttaacatgggaggagttgtgcaaattttaattaaaatgttgtatatctattgtatatagtgacttgtaagtagagaatacatgtatgtacaatgcagtcagtgctgaatgccaaatacaaaatattaaaaataacaatatcatgctttaatgaattagtccattgccatgatatggtctacaacttagaaactccagcatttagatatcagatgatattataacataaatctcttcgtatgcaagcctcaaaaaataatccactttacttccagcactttgtccttttagaatatcacatcaatgaattaggttattgtttacaaccataggttttggttgtgccaacatataggcctttctgttttcatattttgagcattctggctatggctagtttatgaccagaagtgccttctttccagtttctctattccttttcttctcagtgaatttatttatttttgtttcctaatacaaaccctgtggggaggttgatgctcatcatggtttctaaatgacatcctctcacagtttttgttgtttaataaaactcttaaaagactgaccaactaaagctttgtgagtgcacatttatacctgctatctttgaaatcttgcttgttttcaattacacatgctatgcattataattctgtatttccattcctgcctgtcccttggcagaaacttggcctgaaatttagacagtagagcctcttctttagatttcccagcggtgtttgaaggttacacccagcgactggctaatcggacttccctgaggttgactgcccaagattagttttgttgaaggcactgctttcatcttacttactcacattgactttcttggggtgagggcatgttgaaagcaaactttgtgcgatacttggtcttcaaatacactgagatagtatctgagagaatgaggttaaggtaccatggcagtgtagtgcaatgactggtttctaatctgattttgactagcctttgaatttgccttcagaccgccatgaggttcaacttctttattcgaaaaatgatcaaatttcgctaaatgatttatttgttccatagtatcctcaaatatgaaacactcatcagaaacggtgttattgttcataaagtaaaatctctagcagtattgtgagttctcactattttcattctgagacggcttcaaagattggataagcaattattaaaatctggtgtccgtgagcattttatgtagtagagtcttggtgtaaaattacgttcatgtaattgttaagttcttactttggggattcagccactgctctcatttcataaaatcttaatgtcgtgtaataagaagtataaattacatcccatcattttcatactcctcaaatactttatagtactcattatcataccattgcctttagtcactgtcttacataattctcatcaatttctatgactttaactgtcctctgtattgagtttcttaacaaatacttaggtgatcacagagtgccaggaattggccttagtgcagtcatcataaatgaggattaccccgaagtccataacatttattttgatttcccataaaaagtaatgtttataattatggggtggctcatctgctatatactcataatctaacatagtctaagtatattctatagcacatgacaatcacttagcacatatggaataagtgataaatgctttttccttctaagtaaattcttctggcttcctgttaatagtatacaaatggtctcctacaactaggtttgtttttgtgttaatgatagaaacagcaaaaatatgacaaaaatgacaaaaaaatgcaacatagtaatggtattaaggttcaacaaactttacagttttactaaacattggatttgggcttcataacatcttaaataagagggaatgctcctggtcaaccacagtctctgaaaggagcgtattcttaggttttgcggggggagtcagaagtccagcaatctaagaacatttcagattgggaataggatgatgatagctttagaagcgtggtaactcaggtgagaccattgttaattagtttgagaattatcttcattgaagtgaatccactctggcaaagtttcagaagggagtgtttgctgctggttggctgggggaagcatgataagaatcatggaggaactaattgttaaatgaataaatagggtagattgaaacttttgttggtgtctacttgttaccatggctgcagaacaatcagtgtcctctttcgtcctcttcctcctttgttttattgtcagtttattaatctttatatcctaaggctgtagcacataactttgtatataggcatttccaaagactgtggagtaaatgatttgaaaattgaatgaagtcatttttgatccatcttagaatttttgtcattcattgacttgttttcatttcccccgtacacagttgtaccttagatcttgaacactttatatctggattatggtcctagcctcctatttctctcaagttttcctccagcaatccattctgtacttaaagaatttactttaataaaattttgatggtgtcaccctctcattgaaaagtatttactctctagtctattgaatgaaggccaggttttctagtttgctgttgatgatccctcagttttctatgtacaatctaccagtttcatcttagttttcactactctactctctctaagacacacaaagccactgttgccaagacatcgctaatgtgtccctacctctgcatgtttattctacatattcccactgccccgaatactcttccccattccctcatttccagctattgaaatcctatgcataattaattcagtttcctatttaaagagaattgccttatcctccaatattatatgattttaaaaatctgaacatgttaaacaactggttgtgccaattagaggaacacattttaaattctgttcagcaatgcaattactttgtacttctattatttactttcttattccaaattagaagcagaattcatgaattttctatctttcaaatttcctggataatccattaaaatactttgaatataatagatttcttgaaaatgtatgttgatgaaattcaaaatattttagaagacctaaattcctttcttcaaaaattacttatttctacctactggcagttttgaattccacataatctcagaagtgggatagtaatagtttggggcaaaatggcaatagtttggttaaataagtgcatatttattgtaatgactgatatttatgaacagctgcatttagtccacatgttttatgtaaatgaaatttattacaatgtttgaaattttttggggggcaataaaaataatgcttggccaatttttcaccattttttactttttataatggcatatatttgagaccaaacatacatgcatgtgtctatgtataacacagcagtgaataggcacaggctcaaccctttttgttttctcacatcatggttttatttaatatactaaaaatgaaagagctctaagttatgctaatcacaggtacagctgactagttactagtgagaaggaagaacattttctagaatttcaagatacggtgaagtatagtatctactatataagaaacaattggtcaaatattttgaaaaacaattatcaaatgaattggagatttctaggcttcagaattccaaagctaagtttgtaagattattaaggaaggcagtgttcatgcacaaaatattatttagttcttctttaaaaagtacttgcaaaaattactttgaccatctgttgattaataattaaagtgtaataagttgagccatatgtgttgtataactttgtacctttcagccttgtgcattgaaatgtctaatatcatttgaataaatgaataaaacaataaaacgggagatgatgtaacagtctgcttataagtaatgtttttggcccttattcaaaatgtagcagactagcagtttcagcatcacttgggagactattgcaaatgcagagctccaggctctaccccgatctattgaatcagattctgtagttttaaaagatccccaggtgattcatatgtacattaagaattgagaagcactgtattgttctacggatagaagtagaccaaggaacattaattttttcgtctcttgtaactctttttaaaaatactttaaaaatagctgttctgattaatcatggttctgatacttgcaaaagaattgatgaagtcacttgttcaacctgcttttgtgctaacggacttgagactttactcttggctttttcacttataatcagaacacctgatcagaatatacatactgaatacagatatcttaatagtagttaagctaagataaattgtatggcaaggaaaatacattgccacattaccttgacctcctgccaggatttatgtttatcttttatctttgatttttatattcattaatgattaaaaaactaaaattgcatacatttatcatgtacaacacgatgttttgaaatatgtatacgttctggaatggctacattgaactaattaatacatgttttacttcatatgcttagcatgtttcatggtgagtatacttaatatctactctcgcagcaatttttaggaatacaatacattgttataaactaggttgtacaatagatctcctgaacttatttttcctatctaactgaaattttgtgtcctttgaccaacatcttcccaacccctgccccacagcccctggtaaacaccattctactctctacttctatgaattcaactttttagattccatgtgttagtgagatcatgtggtacttatctttctgtgcctggcttatttcacttaatatcctccagatttacacatgctgtctcaatgacaaaatttccttctttttaaaggatgaaaaaggatgacaatgaaatgctagcatttcatagtcagaacttatgtgttaacatttctagtactaatgacatacttcacataaaggattactttacatcttggttcactggaatgagtgcagtaagtaaattttaatgccaagtagcaaatgaatcttttgaaggagctgccactttatatgtgttattacaaagtattattgactttaaatgctgcgtttcattcactttctggatgtggcaaaggatatgaagtcagatcaacttaatgtgcgggacttttacatttgtctctaatgtctgagaaggaaagtgatattctactttatcccatgcaccacaatgtaaacaaatatttttaacatacacggaatagtaaaaatcattatatggtatttttctgtttaatttatattgtggatacatgactcatttcagcagagacttatttagctctctgcatactttaatatcagcaacattcagttaaaaggtatcaggtttctttactgagaaccaaagcggtaaaccattttgtgtatttgtttaattaccagtgcaccatttgaattgacatgttaatataactttccattggagggaaaatgtaatcttttatttttgtttcttatctaatgaaagctactctgttagatgggctagtttggcaatttgacttaggaaaaagtaatatggaatgaagtttttatatgaacaaggaaaataaattaactttactgctcatctcattggtctgccaaattggaaagacattttaggcctcattctcatgttctaattagtctctggaggacattcatggacaattcactgttcattaatctatcgtcttcctttaactttgatttgttcattatccttttagagtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacaggtaaagtgtgtaaaggacagctactattcaagatgttttctgttttatatgcatttttaggtattacgtgcacatatatatataacttatatgtatatacacgtgtatatatacaaagcctaatgtatgtatatgtacaaaaagagacagactaaaccttttcaattttgcttcattgactacaatattcatttcaaaacatattttaaaaatactattcatatgtaccatatcataggaatatagaacataatatattaaatttccattgtgtaacacacaatgaaatgaaaggcaaacttacgtacatattaaactctaaaatcttcatcaactagaacaaagagctagagaaagattaaaggcaaatacagtttttaatcattaaaaaatactttatgacaatatgatgtacaaagtcagattttgattattcaggataacaattttgaaaatagaaaagtgttttaaactatttcaaataaacaataaagaaaaacatgatgaaattcttcgttacataattgtatagaatttagtggggttcttccatgacattggcttgttctttctctcaacagtgggtggtttggatgttttcctatgctttctcaggcacaaacaacagtgaagaaacctttagcaacatttctgctgaatgtgtggagagctcttaggccaaactctctcactttgctgagctagctctgtattagcttatgaaatttttagtcctttccagggtatggacctgatgaattctgtttttatttactttggatttagagaaaattgcttatggatgcctgtttttgccggattgaagagtaccatcccatataaatgttggagttgtgttactttggaatcctcatggctaaatagcatgctcatatcttcccagatcatttactctccaacatgatattaagtgccttcattctgggagtataccaatttcgaatatcatttatatatgtttagtattaaacattgaatctcaccatttccatttaatgttctgttttctaccatgttggaaagtagtcctttcgggttacttatggtttttccccctcctctctatccactcccccaaacccttctctgcagatcacggtcagtctagcacagggatatgagagaacttcttcccctaagcctcgattcaagagctatgcctacacacaggctgcttatgtcaccacctctgaccctacacggagcccatttccttcacaggtctgtcaacatttactctctgttgtacaaaccagagaactgcttccaagataatctaacactgcttttacttgcttgaatttttcagtgccttttatctcctcgtgaagagctggtttgtttttccaagttttattgattccctcatgtgattctgctttgttattgagtcttctctaggtttactatacgttgattcttcataaatatgaattcccgtaatggtttctactttcattatgtaataacctctaaggttctctttgacaaaggctgctaatggttataaaaaacatgaggctcatgaaaagttttatatatgtaacttcgaaaagtgtaggtacatctgtgaaaattgctaattacactatttggggagatttttctggatctacgtaaaggaaatacatacattctaagtgaattattttatctattcattctaaaatatatattctatgtaagaaaaatataactgcaagcttcttcatatgctctcctttaattttgctaatttaaacttgtgtatagcaggctctgtagtatttataagaaaaagtcacactgaaaccaggtcatattctcggcaatgtttagtactttctatatgaggaagactcagtggagttttccaccctttcaatattgtatggaacccaatatacaagaaatagccttataaatgttacagcgtgggaatgaaatgtgctaggattgctagatttgcaagaattactttttaacaaaaatgatttattttgctcaatggagccaattcgaaacgtgctagaggatgtgatttttatcaaaactacactatgaatgggagtttaaaaatgatagacctgatcctatcggctaaaaaatgtgtacatttttggagactcaattttttgttaagatagtggtgtgcatttaattagtaatttatttggcagttaatcgatgcattagctgaaaattctaagctttgaaatagttatgacctccatccttggctagtttacttgcaaagctctcttctcactctctctcattctggacctcttgactctccatcgactctctagactcaatttatcaccattccctccgttgaaatcaccaagacttaaggaataagtgccacctcctaagattaaggagcatacaccaagcaaagatataggggtttttttccccctctcattatcactttattgagctgccttttctaggttttctccaatgcctattctggtagcacattttcacctcatcaccaccttcattaaggcatcgctcaggtatgactccttaatgaagtaattacaaatggacttacatcttgctaggctctgctcattctacctttgtgtaaatattaccaaatacataatatgtcataaatcacagataattcaacaaattcacttacttgttttatttaaaataagccattcaaataaatgtaatgtttatcatttaaaaaagacacagcacaaatcacaagagatgggggatggggaatgatatattctgtcactaaaggaagcatatcagaagatgatgttacatgtagttaggtttgataagtgtatgccttaattattcacactaagaacatttatttcaaaagtgtcaaaaggactgagctttcactgcccctacaggctgtacctgctctacttcaaaggaactcaagacaggctggatctgattccatcagaaagctttattaaagtgtttacttgctggtctacagagaaaaataacgttctctataagaggagagagccatgtgggtgactgtcccctatggaaaacacgtgcatgccctcactccccagacacatcactctgctttaacttcatttatttattcaacaaataagtattcttaatcacagagacaaatggcttttattcagctctcctaactttctaccactgatgaaacatttttctcagcctctacactcagcgggttcttcctctctgactattctgtgtctttcattacctggctctttctgttcttccaacttctttagcttatgaaactcatgggaaatatcttggcattcttatctctgtacttgttcttttatcaacataatttaataataatttaataacctggcttcaatctgtattcaatctgtatgcaaatgatcattgtatctctgtcttcaccacttccaatcttacttgagttatagccacatttccaattaattttcaactctttgtatgtatctataccttgatatccactaatatctcaaacctagtatgtctccaagtgaagtttattatgaagtttcttgtccattttttaatgttattcagagccctaataatacaatttttttcgcttaattttgtccatataacaaggctactctcctaaactgcctcgaaaagatttatgatatattaatattttatatttttatgctcattacacacgtatttcatgttccttcaaccaaattacatcactcgttctcccacacaggtgccccaaaattttccatattagcttttatgcttcccttagctcagagtgcttttgtctctgttttaaattggccaacttaatttgtatttctaggcctaattagtaagtggcagaacctgaattcaaatttgcatttattcaactccatgcccatgctcattatagtagggtgacgctgcactttctcgacggtgattcttatatattgcgttacgcacacatagagcagtattcatacatttgattatttagcgcttgtgtttgaatcacctattatgtgccaggtactgttattgaagcaagtgacacataaacatgcaaaacaatctgtgtctgaaagtattctaattttattatcctcctgctgtcttccctcatgccatacgtttttaactcatttaataaatggtaaggccgggcgtggtggctcatgcctgtactcccagtactttgggaggccaaggtgggtggatcacctgaggtcagagttcgagaccaaccgaaccaacatggtaaaaccccatctctactaaaaatacaaaattagctgggtgtggtggcgcacacctgtaatcccagctactcgggaggctgaggcaggagaatcacttgaacccgggaggtggaggttgcagtgagttgaaatcatgccattgcactacagcatgggcaacaagagtgaaactctgtctcaaaaatacataaataaaaaaaataaatggtatgatatgagccttttaattttatctgtgagcttttctgtttcatgatcctctagcatagcatatctggtagcagaattggaggccaatatttcatcaaagtcatttccctcctgatgcagtagatgtgacttatgaaataattagagaaatcaaggattaccgtgaggtttcttacttaagcaactggccaaatagagttgccacaaaccaagatgggtgagactgtagaaggaacaggtttgggagtgaacgttaggatttcagttttaaacatattaatcttgaggtgcctatgaggctatgaatgcatgtaaagaaggggttctaagatcagagttgaggataataatttagaagtcaacacatagatgttatttaaatccatcggccaggataagattgccaaggaaaaatgtgtagacagatgagatctctagatgtatatatgatgaggcatcagcaaaggggctgaaaaaggtggctagaaaggggagagaaaaaggagaagatagatgtggcattctggaatccagaagaaagtgttttcagagaaaggaagatacctaactacattaaatattgctgatgagttcaaataacatgatgattgaaaattattcagtgaatttaggaaaacagtagggtacgatgtctgggaaatcctaatatatagcagttactacagtggaattactaacactcctattcactcttaaaactttcccattttgaccgataaagttacatgctctctctagtttatatcccctttaataagaacaatttcagtggtgtgtgcatgtgtgtgtatttggaggtgttgctgattagagtaggttcaaacgacagtaaaagtgaaggctaccctcattgtaacacttaaaaaaacaaactacaccgcgagctgggtgtagtggctcatgcctgtaatcccgcctcttttggaggatgacgcggggagatcacttgaggctaggagtttgagaccagcctggccaacatggcaaaatgctgtttctactgaaaacacaaaaattaagcgagtgtggtggcacacacctgtaatcccagctacttgggaagctgaggcatgaggattgcttgaagccaggaggtggaggttgcagtgagctgagatcggccactgcactccagcctgggtgacagggcaagactcggtctcaaaacactaccctgaatagttgatggccacagggacaaaaacatacttcttttaaattaacccatcctgataactaatcatgtgtctatatgtattagttcgatttttgatgcaacaactacaaacctagtgcccctaatcaacacatattcattattttacagttctttagttcagatgtttaaaacaggtctcattcagctaacattaacatatcagcagggctgccttccttttggaggctgtagaggagaatccatttccatgccttttctagcttctagaggctgaccacattcactggctcattgccccctttcaacttcaaagctaacaagggcaaattgagtctttctcatatgacatcactcttacctatactcttctgcccccctacatctacttttaagagccttcattattacttacttgctatgtgaccttcagagaatttcttgaactctgggcctcagtttcctcatgtgtattattgaaactgtttctaactcatatagttattaggagtgttaaatgagattaattttataaagaacattgcatggtataagcacattgtaagttctcaaaacccggcaaccaatatgattactactttagatacatcaggggttagataagattttgtggtctgatctgagaaaatttttatgtttttattagcacttttatgagaagagatagcctggattctgatttataaacaaactcacaacctgtatagagttcggcaagttaatataccgagtaaaagattctaaggaaaaggatatccttttttgttctgaggttgctgaggaacaatcttggaaccatgcagagcagaacatagtaatgccttttataaagcagaaaaagcacttctgggtgattttacatccagcaatcctgtgttgggaggggatgaggcagaggagatttttcactctatctctgcctttgccccctcctggcacaacttgtccctcagactgtccacatattgtagaaagtaattggcaaacagaggatgggaagccagccagggagaccactccttagattaaaagtatcactaatttgcttcgaggaagcctttatacatcctgatgtgactgaacaaattacccagaaacagaattgttaggttttagctcaactctataaattggtacactgaagacttctgagtagaattttaaaactggaaggaaccttgaagtgaatatatgtgatgatgttattttcaacagttacactcttatcgtttaacttcttttgaaatttactttattgtgtgtaagaacacttaacatgggattcaccctcttaactgatttttaagtgtaaaatacagcattgttcagtataggtacaagttgtacaacagatcttgagaattttctcatctttcatagctgaaccttcgttaattagcagcttcccacttcctcctctccacagcctctagcaactactatttcactctctgatttgatcagcttgagtattttacatacctcttataagtagaatcatggagtgtttgtccttatgtgactgtcttatttcacttcccataatgtccttagggttcatccatgttgttaatgtggcaggatctctttctttttgaatattaatagtaatctcttgtatgtatataccacattttctttatcccctcatccatcagtggacactgaggatgtttccacatcttggctcttgtgaatggtgttgcaatgaacatggcattgcaggtatcccttcaagatcctgatttcaattcttttggataaatatccaaaagtgagattgctagatcaagtgggagttctgtttttaatttttgaggagcaactatattattttccataatagccatgccattttttacttcaccaacggtgtacaatagttccaattattccacatccttactaatccattttttaatagtaggcatccaacaggtataaatgtgatagctcattctgcttttcatttacatttccctgataattcataatgttgaacatattttcatacacctgttgaccatttgggtgtcgtctttggagaaatgtctgttcaagcctttagcccatttttaattgcgtttttagtttttttttttttgccaatgagttgtaggaattctttatatattttagaagataaccagttgttaatataatataaggtcttcaggtctgatcacaaaatcttacctaagccctgatgtatttaaaatagtaatcatgatattggttgctgtctttttgataacttagaatgtagctataccatgaagtattctttatataattcattttatttaaccctcctaatagctctgagttagaaataattctcataatatatatatatggtttgtattttcccattccatagattgccttttcacagtgttgatttgttcccttttctaaacagaagatttttagttttatgtagtcttaattctattttttttgcttttattgcttgtgcttttggaaataattgcgaggatgaatgtcacaagatttttccaatgttttcttctaggagttttatggattgaggttttacatttacatattttatccgtttggagttgatatttgcatatggcataagataagcaccaatttcattattttgcacgtggatatccagtttttccaacaccatttgttgaagagattatcctttcctccttgtgtatgcttggctctatcgtggaacatcagttaaccctatatgtgtagatttatatctgggctctattctgttctattggtctatatgtctgtcttcatgacaatacaatttatttttaattactgtagtttagtaatatattttgaaatcaggaagtgtgatacctccaattttgtacttctttctcaaggttgatttagccatttgggattctttgtggttccatatgaatttcagagtttttctctgtttctgtgaaaaatgccattggaattttgataaagattatattagttctgtagatttctttgaatgtaatgacaattttaagtccttcgatccatgaatgtaggatgtctttccatttgattttgtcatctttaatttctttcatcaatgttttatagttttcagtacatactctttgacctctttagtttattactgttttctttttggtgctcttgtgaatggaatttgtctcctagaaactcaactaatttttgtatgatgattttgtatcctacaactttactgatttttaaattggttctagtgtttttaatggattctagggttttctattcataagattatgtcatctgcaaataggaataacattcttcatttctgatttatatacctttacttttttttttttgcctaattattctagcaaggacttccagtattgccatcggtagaagtggcaagaatgggcatacttaccttgttcctcctgttcctgatttcatagaaaatcctttcagttcgcagttgttgtgatatgacctgcgatctttttatatatggcttttacattgaagcaatttccttctattcctagtttgttgagagtttaatggttttttttaaatagtgaaattgtgttgaattttgccaaacaagttttcagcatctaatgaaatgaacatgtgacttcttatttattctgttaacgtggtgtatcatactaattgattttcatgttgaaccatccttgtatcccaaggataaatctcacttggtcatggtatatgatccttttaatgtgttgttaaaatttgccagaattttgttgagaattttgcctctatatctgtcaaggatattgagttgcagttttcttgggatgtctttttctggctttggtaatgctgaccttataaagtgaatttggaagtgctccctccacttcagttttttcaaagagttcgtgaagcattggcattaattttctttaaaaaatgtttgatagaaatcacttatgaagtcacctcgtcttttgcttttctttgttgagagtttaaaaattacttactcaatcccttacttgtattgatctattcagacttttccatttttacacagttcagatttggtaggttttatgtttctaggaatttaaccatgtttttagattacagtttcttggtgtaaaattgttcatagtggtctctttatgaagattaaaggagcgttattgtgttatagtccaaaaacctagaggtttttaaaaaaatgatttagtgtaagtaacttaaaaacaaaaagttatttaaggtaaagccctcattaagtatgaaaattttataaggatagtataaccaaaatacatcatttattccactaggtgtgtctgcatttaggaaatatgttaaatgcctagcatgtaatttacatttattatttctgatcttcaaaaaaatcttacaaagatgtaactccacaaatggagttacctatcaaaataggttaggaaattgatgcttaaaaaaagctttgaatagtgtgggaatgttatttttcttcttgacatataagtgataattctaaataagaataggaaattttctgtcatccatgtcccaaatacatttcctgttttgtcctctgaattattctattcatgtttattttgatgtaaataagaattttaatggtgttaaacttttcgaagaacattaaggaatattccatagctaagatattaagatgaaaacaggagtataataggaatctagtctgtgggacctgcatatgctattttctctctattactcagttttctcatctctaaaataaagatactttcaactttccatggggtggctaaaataattaatgcatagtgtatgtgagaaaagcctccactatcacatagagtgttagaggggaaagactccattcaccttcttacacaacaggcattcaataagtagttaagggtaaagaaatatttacaacaacgtggatcaacactcttccattttgcattatatttataaatgataatgtaatcttaaaaatataagtcaaaaaatgtagaatgaaagtccatttttacatttggtaaagatatttggagtttctggaagagatgatatataattttaccaaccattctagaaaatgacttttttgtctcttgataccagagataggtccagaggtattgctgtggatgttacaaaaatagagtcaatttttgcgaaccaaggatatttgaatgctctcatttaagtcatgtttattacattttatgggatttgtcggttcctagaatttgaatgaattattggatggaatttagctaatctgtgttccggtgtttaagcaggtcagggcggcttatttgtaatcattaatagtttgtttggatctccacatgtaggctagatgcagtatgccttctttaggaagggcctcttaaggaatatctttttcaaacatttattttaatacttttttatttttatgttttattatttttcttttacaaatcaagtctttatggaagtaagaattcgtgttacaactgattgaccttagttgtgtgactcagttatctcttggcatacctgtgtaatgcttagctcacctgtgtaatacaggtgtgcttaccttgttcaccagtaactattgccatatagcaaatcaactcaaaacttgggagcttataaaaacaacattcgtttttcttattatctcttttgattctgggtctcagatgggttcagggcttctcatataggtgtaataaaatagtagatgaagctgaagtcattttgaaggcttcttcactaacatgcctggtggctactgctggaacttcagccagggcagttggctggaacatgtatatgtggccttatttaatctgcagtcactcactaaatgctggctggattccaagagtaagtgacccaaagagtaccaagcagaaactctattgccttttgtgacttagtcttggaagtcacatagtataacttcttccatagtcaggggtccatcctagtcaaggggcagaaacataaacccaactcttgatggagaagtatcagtgttacatccgaagaataacatgtaagatgaaacatattgtatccatcttaaaaaaatacaatctgtcagaacttacaagattcttctgaagaatccaggttagttgggaaatgtggctagcatggtgcctaacaggtgttcaataaagtgcactctacttactgatgactgtacttgttttaggtaagcttgtacagatcttcaaatatccaggctcctgattaagaagtttgagaatgtccttgcacataagtgtcacagagtaggagccgaaatggccacttaattgctttctagcacaaatgaaatttcaaatccatttggaaataatttgtatgtgtaatttaataccaagaatattaagtagacactgaaacctctacacctttcattttacaggtgaagacactcaagctgagatatgctaagtcatgtacctaagattacagagcagaaatatttggtctaggatcctgatatcctgaattttgttaaacatgatgtcttcttaaggattataattattttaagctaattcatcacactgtcacattttctgtagggcgatctctagtttctacattcattaagtaatttgattttcttttttgcattaattttattacaatctattttgttttcagaaaatattttaatatttttaatcttttctctttaaattattaaccttatattttaatgaaactatattcaaagtgttgtaacatcataattaagatacatgacaaccatgattgaaaatgaaaacttagatacatttctttcttttcttttcttttctttttttttttttttttttttttgagatggagtttttgctctgttgccccggctgaagtgcactggcacgatcttggctcaatgcaacctctgcctcctgggttcaagcaactctcctgcctcagcctcctgagtagctggtattacaggtgcctgccaccacacccagctaatttttgtatttttcagtagagacgaggtttccccattttggccaggctggtctcgaactcttgacctcaggtgatccagccgccttggccatccaaagttctgtgattacagatgtgagccattgtgcccggccatacagatatattccttaaaatgtataattagtggatacccatgcctaattttaatccctgctatagaattctggcagcacatatccttgcatattgtggtctttatctacaaataatatcagtgaaaaaatgtaataatgcttggttaatcaacataaacttgttaccaaacttgtagattaacacagagcctcctattatgtcatacatgtgttaaatccatgtgggtctcaaatctactagcaaacttttttgttttcactaagagtttacccccttaagcatgtcaatgtaaagaaaaatattaattcttttgaagagataccttatttagtaataattagagtgactttaaaatcaacacataattaacggtcacatattttgttcattataaagtttaatagaaatacagtcattttttaaattatgagaatgctatcaattaaatctttggggaaataaactatctttggaaggattaatgatgagttgatggtatcgttatgaaactcctcatttctagatcatctgcataccaattcagctacataaagtcatgttcctcttttatgtgtagcaaatccagattttcaagcttagcattttaaatacttacttctattaggtaacttatttaaagtgtaatgatgccaatgatgagaggtatgtataacaatgggattacttcacaataaaacttacttatagtgaatatttatgaaaatgtttattaggtgtctctgggaactctggtcaatttaaaatcttagtacattttatcttcattataacatgtcccaaggaaatttttggctgaaagattagcattataaaaatagaactttaattagaaatttctatattgtgtgtcagattgctaaatccagtggcaattatctgcttcctaagatatgtagtcctctttctgaaacattcaaatttactttataatacctgaaaaagtcatttcaagaagaaatttagatcattaatggaatgagaaataagattagcccgtggattcttctacttctactttataatttaaatttcaggtgagctaggtgattaaagtcattttaactatttggtacctcaaatagttcaggaacaagtatgccggaagcactgtagtattaccattaatttaataattgcttattggccacttgatcctagaagccaggaataaatgtgaaataaagtttttataagctcttaaaaatcttaacatttctattgcttcatagagcatgattatagttaattatttatggagtcaataaaggaatttagtatggcaattcttgcatcatgtattggttatgatgcttttaagaaagactctaaggaaagttagaagtcaaatataaagttgggaaaattattagtaacatttataacatacgaaggattgatagccctcatatataaataatgctgataaatcaataagtaaaactagaatgccccaataggaaaattcataaagaacatgagccagaaaatgacaaaagcgaaaaagcccatatatcattaagtatgtaaaaagacataccatctacttaataaaaaaatataatataaacaatcaaattatttttaactaccagataggcagattgaaacagtgataatactgataattttgcagaacataaagaaacaggaaacatcaaaagttgtaagagggcttatgacagaataaattgatgctgtccttctggtgcataattttttaatcacaaaatttaaatttaggagtaataatctggtaaatgaaatgatgtaagacatagttaaaacaggttttcaaagagggaaagtttaataaacacttgaatagtgatcaccataggattaataaaacttagggtaaatatttttaatgcaatatcatgaaatctttaaaattcatgctatagttatatacttaataccatgctgtaaagatagcactgatacatggttagattataagcaaagttttcaaatagagtatatatctgtgtgttacgtgtgcatatatatgtgtgtgtgtgggtatatacatacagcaatacacatatctaccaataatactaaacacttacatagggagtatgttctattcgaagttatacatatgggttgtctctaacagcactttatctctgtgcctatttccctagtctcatcctcataactagaactctaaatccattatgtatacacactgtgtgtgtgtgtgtgtgtgtgtgtgtgtgtgtgtgtatgtatgtgtgtgtgtgtgtgttttgtatgtgctataacatttcacttttgcttctatggtgcaatttttttcattggaaatttaacaacttactatttttaccgtcttaatttttaaacaaataagtcattattactcagtggcccttgaaatattgaggcaatatgtctcaaaaacttcttgttaggtgaatggttacattcactccttctttctttctttttttttttattatacttttagggtacatgtgcacaatgtgcaggttagttacatatgtatacatgtgccatgttggtgtgctgcacccattaactcatcatttaacattaggtatatctcctaatgctatcccttccccctccccccaccccactacgggacccagtgtgtgatgttccccttcctgtgtccatgtgttctcattgttcgattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtatatgtggcacattttcttaatccagtctatcattgttggacatttgggttgattccaagtctttgctattgtgagtagtgccacaataagcatacgtgtacatgtatctttatagcagcatgatttataatcctttgggtatatacccagtaatgtgatggctgggtcaagtggtatttctagttctagatccctgaggaatcgccactccttctttcaatagaaaattattgagtaattagtatgtcctagaaactaccataaagctctttaccatgataacccaattgtggtttggagatttactaatgtatcacaatatgcaggttaaagactgctgttagaatgtgttactagtcacttaatgtttattaagtgccatctaaaccagtcattctagatctggttattaaatttcactatgttataataactttttcattccaatgtgcactgtgaatcagcaagggaacgctattcattgtggtcatttggaaacccagcctgatgaaacagctactatctaggatactcccagtcactccgcaaagggaaagaaaattctgaaaggtcttgtgctggcaattaattgcttgaactggaagtgacatatctgcttcagttcacaactcacgagcacaactagttacatggtctcacccaacttagaactaagaaatatattcgtattacatgtctcaaaggtagaaagctggaaataaatatgaatggtgttaataactgctacactgctaaatttatgttgtcagaaacatctaaggacaaaatgaactatgaaataaaaacatggccatgctctcaaaatttgttttttttgatatgaactcttcaagcataaaaaattaaattccaaaattgaaatcataaactaagttaacttgctaaaattcatggggtcaaatatgtgatatttgaatactcgctaatagaaatgtctcaaaatgcaataaaaggctttgggggatagtgagccctctgtcagagtagtgtttaagtatagactacctaatgagactggttgtaaaaggcagtcggtcacgggacacatggcttattaatatgttcacttactatgtactggaaccatatagctgtctaagatgagctttcttctcctttgcaagccttaaatccataattctaatcgatgggtcttgtggaatagtggtaactattatggaatgagagacagtgaaccaagcatggggaacatatatggccatattattgcccttaaggaatttacaaactgagtaagtagagaagatgttgagagtagttctaaatcctgaaataatttcactttacactcggaagaaaatccaaaacaccatcgtgatttgttccctataggtatcctaccttctttcctacccttaaccccatttctcagctccagatacactggcctactagcttggcatcaaatacgccaagcatactttgagttcagtgactttacacatgtatctccctcttcctggaagggtttttcccccagttattcatatggcgcacttcctttaccttagactgcaaagagatcttttctgactaccctatttgatatgccactaccattgttctgtcttctttcaaagctttaatttttttcctcattgtagttatcactactgacattacgatatttgcaggtcgtttttccctaatgagtaaaaactccaagaggaaaaggactagaatatatactaggtacataaagcatattgatcaaatgaatgaaagcatcacgtttcttttatatgccccagtttgcgattgtattgtatattctaagagttgagtgaacagcaatacttaagggagcagctgcccgtgaatctaatatattgttcagggttttgaagcaggtcctgcaatataaaccctgctgcagcacagttttacgtcatcttccttctcttactatgaattattaatcccatcaacctcatcgtaatagaagagttacgtataaaagaatgagtaatacaaggtgggatatgctaccttgtatttcaaacacatgtttgatttttccaaactaatttcagtgattggagagatcgtacaaatatggatatataaggcttattactagcgtgatgaatgggatccaagaatcggcagtttatgcatcctacaatggtccatcgactcgtactcaggaagatttccatagagtaagttcatcttgaacagagctttttacgaggcttagataagaaaagaatgaaaatactttaggtgggacatgatttcaataaatggtattactaaagccatggaaataaccctatgcttaagagatggacgaaacagatattttggaatctttgctgctctaagattctttatcgcctaatagcaaaaagattagataaagaggaaaactatcacttactggtcaaaggtagaaaatgtatggagaagaaatcagtgaaaagtgatgtaaaatatgtaactaggaaataaataaggctagagaaggtaccagaagtagatgagcagctgtggactgttacccccactcccgtctcaaatataaggggcgtagcctgagggttttctgttcaaaacaactttgactgtgtgtgtgtgtgtatgtgtttctgtgtgtgtgtgctggggagaaaggttggggtgggtggaaggagagttgatggggggagagagacagcaaacaatgttgaggctcaaaatgaaatttctatttttaagtacattttgaaaatattggcttatataaagttttcactaatttttgaagtaatattaaatatatgagtcttttaacaaatattgggcattcataatttgagatgtaatacctaattttgaatgaaataattgtttttctcaataaattaaagcataagaattattggagatttttcaccattccatgagaggaaattttagtagtgtacaaaagtagattaagatttatagacagcctttggcttggagaaacttactctactcagtgcctgaggaccagttgtgaagacagtcttatttgtgttggacaaaaacgtcaggcctttgaaaaaaacaatattcaaagtcagtattttgattgtatttgaagttcttagtgatgtttctaaacgttacgttaaatattagaaaaatattttcatggtcatatgtgtcatggtcataatcaatatgatagcttagttttttaagagtacaaaaatttaggccaggcacggtggctcatgcctgtaatcccagcactctgggaggccgaagcaggcggatcatgagttcaggagttcgagaccagcctgaccaacatggtgaagccccgtctcaagtaaaaatacaaaaatcagccaggtgtggtggcacatgcctgtattcccagctactcagaggctgaggcaggagaatcgcttgaaccccagaggcggaggttgcagtgagccgagatcgcgccactgcactccagcctgggtgacagagtaagactccgtctcaaaaaaaaaaaaaaaaaaaaaaaaaaaaaagtacaaatattagagcgaaacgaacatcaacaatttagtgaacgtttcttgtgtcagtttcagtctcagtatactgtgaaaagggaatgaaaaaaacatgtttaaagtgagtaaaattgattgacgtggtctttttcagcatgttttaagtgtttttcgctttgccaattaaaacttctattttattatttacctaaatctaccccccagtaaacaaaatagtatttccattttcataaaaggcagttccttttctttttcatcacccccatctttagagatctttgactttctattttttctcactgcctgacattaagattccttctgttaaatgtttttgaattacatttagttcataagaaatgtttcccctagactttaagaactttcggacataaaatttttcgccaattttgttcattcacttaacaaggacaaaaaaccagaaagagttgggtgacaatttccattcagtaaatgttctttactaaatctgaattgcatattgtggaatcagtaaatgtcaagaacaagccagtctatcttttcacaaaaaaaaaaaccaaaacctcgttgttactattttctattgtttttctagtttctattttatttacttttgttctgatctttattctttccttctattaacttcccctgtggaataactccaattataccatatcatgaagcaaaacatataactgtagaaatacaaaaggctcaactataacactggactaagcattggctgatctcccctagcatacctagcaatattaatcactcagataattaggcactgtcctatatttttgtaagatttataactttaaatttttcattacatatttttttccagtgactttgagacttatcttactttttagtgtgttaggtttatcagtggtgattttattgttatacatgacctcataatagttgttttttctttcagtacatttgttttatgtttaaatttttatatttacatgattaacttatgcaaattatatgtttaaaaatctgttttattgccaaagttgtaaggagggagtcaaagttcctagtcatttatttattagaattattcacaggagtgacaacgtgcgtaagtttatgttgaccagtcaaattttctcttcacaaaggacagaatgtgaaaagcacagattcttttttggtcatggggcagggaaagataatataactctgactgtgagagaatgagggaggagtagagaagggatcacatgttagtgtttattcttgtttcgtagaatgtactcatattggcctggacagttgccctttgattttaggagattaaaatatactaagcatgtaggcacccacccatacacacatacacaacacaacacacacacacacacacacacggacacgcaaacacagttgctaatcagtctgacttttatctgtaattctggttctgctacttactaaatgtgtgacttaaggtatattactgcacattgtgctcacttttgtctatttggatattttagttgacatttcaccttacataaaaaatgtgttgaaaattgttagcaagaaacaccatagggcatcatcatctgctttgtgatacataaaacatttgttaaaactgttcttttcttctgtaaggacactcaacagatttatcaaataaccattttaagtgtacaatacagtattattagagacaacgttgtgtagcagatctttagaatttattcatcttgcatgatgaaaattttatgcccattaattagcatttccccattttctcctcctttcagcctctaaaagccaccactctaatctctgattctctgagtttggcaattttagatacctggtgtgagtagaatcatgaagtatttgtatttctgtgtctagcttttttcatttacaatataccttcaaggttcatccaacttgtcacatattgcaagttttccttctttttaaagactgaataaaattccattgtatgtatttaccacatcttctttatccattcagctatcgggcatttacgttgttcccacatcgtgactatttttaatcgtgctataatgagcactggagtgctaatagctctttgagatcctgatattttgctctttttttgataaaatggcttcataatagttatttcctcatatcattattctaaaaattgagctgctaagtataaatctgatcacaaagtaaacatgtaaatattattttttaatcacacatgaaggatttttatagtaactttgtgtaaaggtgggtattttcttgtaagttattggaatctattaattttaagggagcattccaaattttaagaggtagaaagaaacaaaattccagtgcctatgtagtttatttcattttaatttaaattatgagatgattgaatagtgttcacattagaagtataggaagatagtttagaggtcaacttctttggtcttgtatttctttttgttaatgaaattaatgtgtgttcagtggaaatatgcacatgtgaatatactgttagtttctttaaataaattatatctccaaatgatataataccatgaagccactacaaagttaagatataaaagagtttaattgcatggcatatttttacaatacattaaataactgaaaatgtagctaagacaacattgtgactggttttgaaaaaataaattatttgtgtggttatacatctatatatgtacttagaacaaaggttatattcagaatattttacactagactcttttcaattaattttataggagtttcatttctctgaattttcatttgtcagtgaaattacatattttaaaacatgcaaaaataaataaaacatgtaatttaaaaatgtaaaactcttttacatatatttttaaatgtcaataaatgaaaaactcttacatatatttttcaatttcaataaatgaaaatcaggaaaatagtgacatggtcttcaaaaatcacaatttaatagagaaaactgaagataggaaataatattctaattacggacaatgattaacactggcagaactggtaaatagtacactataaaataaaatactacattaagatatataatcagaggacatcatacctcaatacatatgtgtttgttttgttttttaaagacacgggctaacattactaattactgaaggatggagaatgttaactgagcttgtaatgataagccggtgcagataaataaaatggtataacaatcatcacagtttataaaaccctaagagtttgttaaatgtgcataatagcgtccacaatcccgctaacacaatctccaaacatttttgtgtacacatagtgtaaaggatccagaatttcaatcatattctcaaaagaattcattgccccaaaatggcaatgaaattctgagaaaaatagggtatggtgagactctgaggacttggaaagccaggcaaaatactacttatttctatggtacagacagataagtcctttatgttatattatccatgttgaaaatctggtagattgggaagcaggaaagaggtttcatgtttcagctgcaaactttgtgttcgtggaaagacaagagcaagtgctacataagttgagccattcccagaacaggtagtgaaagggctctattgcttcaactgaagaatgtgttatgctcttatgtataagagggattcttcacaccttataaaatgttcatatcccttttacgtgctttgtattatttatgccccagtgagcttacttgtgagataaaagatgaaatttttaactctgtcaactaaaaacaaccttatatatcttgaatgagttgaccaaagtagtatggttagaaactgataggtatgtcactcaacccaagttttccaatttctgggctctgaatcattttattagcctaagctccttcctgagtgttgatcttagataatgaaccagttactcttagataatgtctgtgatgatgaataatgtcacaaaaattactaactgatattggacaatcattatataacaaacattgctgtaaacacttttcatacattaattcaatgtttataacaaccctattgagaagattctgttaatatatccattttacacttgagaaaattgataagctggttaagaaatctgtgcacagttatgcacatgaaaagcagctgtgccaggatttgaacacacacacaatctcattccagaattgattctattaacctgtatgctaaaatgacacaacatagagctttatgaagctatcattagaggaaaggttgggttttcataaacacacttatgcacacacttcatgatttactaaaagtggatgaatatataagcaatataatgacaaattataaatcaggcaaccagaaaataagaaggtaaaatacaggcaggtttaaaataaaggttactttataaaatgaaaggtgaagtttgggaactggtaatgaggaagaataattgctgtgaaatctatcaacagatgacttcattaatcttttttccttgaaagagattcagatgatattaccatctctttcaggagtggaagagagagaattggagagaaatgttttaaagattctgatttatagcaagcctgtgaaaaaatggtgcattaaattcccatttggcatcctagttgtagtaagataatacatcctttctaaaaattccatttgatgaataagcaaaccaattcaaaatgactccattttattgataatagcatcagtgtcattaatgagaatgctttttgactaacagcaattaactagatttggtgaactgagcaattgaacattgaatttgaaatcagaacattcggcactgaagatgatataagtacatattagaatgattgttgattatttaaggatttattaagttgatgaagaacattaaagtctattatatcctgtattatttaggatgcttggtttcaaatgtactcaagatacaaagagaatttgttggctaagtaaagagttcaaggtttgctcaagggtttaatacagagttttattatggatttaaggagaagtctttgcttctctgttaatctaagcctaccctccataacttttcgaactcatacagaccggcttccctcagcagatcttggaaactcttttcccttgtttacagctaaatgtaaagaatatatctttacccaaataggaaacaaaaggtctgagtttctctctgcttggaaactcttagatcatatgcctggcctgaacacctccctgaagcaaagtacatagcagtatcccacttggcttgcacaaaaaccgagcgcatatctagaactgagagtaataacaatgctttccaaatcaccaggctactgtgccatcagagagtagaagaaaggatattgactgtataattgcagtgcttactacagtcctcctctttgaatatccaacattgctatacacccttcatagcatatattcactttcaaagatgctcagactcctcaaaaagagcaagtataaaacattatccagtgattgcattcagctccaaggttgggatatctgggtgattagcagtccctttcaattagtctttatgatccatccagtggactatgactaagtgaaaaaatttgatgtccagtactgctaagtaaaaagttagaagggcacatcctgattaaaactaaactaaatttataaaagaaaccaaattgaaacagatattatatcctgcactttcagagccttcctggtgatttttccttctgttcattataaattttgctaaatacttgtcttcatcatgatatctgaagttgacatattttggggttttgtgttactttattattctacttattgtgttgtttaaaagtcctggtgcttgccctaggtttgagtgataacaaggtgtttttagttagacctggggtttctttggcaatcagatttgtttactatttataggctttcagtatttgttcttatcaattccatgacccagtaacccaaattctatgatttggttttaggcttcaaatgttaacctcttttgacatctttaagaggcctctgtgctttgcacaatcccctgactgagaaaatttgcagcacagggttggggtagagggcatagccaatctttgagtatatctttgaagtatagattacatagaagctgcttcttcatgataggagggatcgtctactttgtcacaaaagtgctttagggaagcactatagttgattttttttagtacttaagtcttacattctgcctctcctgtctctgttcatacaaacattcgatttggagtaaaaatacaaattggcttttccactcatatcaggctccaaattatcagcctctcaaggcgttcacgttataagccacaggcagagagggcttcttcagacaaagctatattttcttttttttctgtacttcaaaaacaagtaaccattagcatgaggttttttctttcttggtttaaagaggccagtaggtggcaacatttttgtttctatcaaatctcctaatagtgttggtactcgtaaggcacatgacttaggataaaatagaccattgtttaatcaactgttttttaatcatgtaccaagtatcattttgagttggggtgggggaggtttatcatccttgtcttctcataattcagcctgttccacattataggatctattaactttcaacaacccacttcctgataccaaagtccatataaactagaatgatgtttggtacaataatggaaaactcttctcaagaaaacttgaaatatgcagacacacacacgcacatgcacacacatacacatacacacacatacagaaaacatccacattggagcagtaacatgtgacatcttttcttccattaaagatttcttgtaattaaaccttgggaattattggcttatgtaacagaaaattccaaaggaatggcaggattctggtaagcctttaatccaaatattcacattgtcatcacactgcagctccgtatctcagtggctcttttggctcttcactcttccgttatctatgccaggtagttatttctttccctatacagttttgttatgatagatggctgccagaactgtaacatttttttctttgcttatgtcaaaggaaaaataagtactttttttctcagtcaagcagaactctggacaccttctggttggaacatgttaagtcatgtttccacagttaatatactgtgttaaagcataaaatgttgtagttggatttttgttctatgtccctggcaaaaaggatttatttaaagcaatcaggacttatgcatgggattggggaggtgattaattgctcccaagccacaagattccttcataaggatggaatatagtttggaaattattttatggtagtatttgaaagagttcagtgttttcccatgatttaataatataaatccttaatagaataaaatatatcatgaattgcaagtgtatttgaaagtgtgtgtgtgtctaattttattggatccagaaaatatgctctattttttcttggaaaatgctgtgttttatatccactgcattttttttatgttctgtacatttcagttggatttctttcaaagggactgccctctatcaatcaaagtcatctttagcataggttaggctattactgatgaatcaaatatttctagagcaatactttaggacctgtcccacaactaatatattcaaaatttagcaaaagtttattgagtacctgttagaagcaaaggactatgctaggtgttctcatatacatgaagataaatatatgtcataaaacaatgacaaattggctttcagaatgtgcttatttccaatatcatcatatttttcttttctgtcatttttcattttatcatataaagaccttgaggggtgttttttcagagaaacaataaaccaatgatggatgagcccacttgagttagttacatactatacagcttatataaagcataagcatataaaaagtatatgcatctactttcatagtttggattgttatttaaatttggtggtattacattttcttctcacagatgactggtcttaaatgtgtactatagaatttacagaaacaaaccatagggtttaataagctgaataaaatgaagctctttatctggttagattactttgtaaaggacaagaataggggagcctcccaggtcaacctgatgtatgattttccatttttctaaataagttttattgacttttacattttaatggaaaatgagtaattagcagaggtgcagattatatttggcagaaaatgattataatatttttatcagagagtaaaatatatgcagaaatagccaagtaatctgatttgttaataataatagtatcctgattatggttttatcttttgttttaaaataacatttatatagggtcaattttgaagataaatgggaacctggtgaactctgtctctttttctcagagtgtgtgtgtgtatgtacataaatttaaaaatcgaagttatagttaattggaataagaagtttgttgaaaacagtttgatgtctggtaattgagaaatgtttatgaatctgacataatttactaaataatggagagagatacattattcagaacattatataagtacctaggccaaatttctgaaagatccaaggtgagagatatatgtataattatcttggtggtaatttactcatgagtagtattgacattgagatattaacaatttgtaccgacccacttgtagctgagtatatattcttaaattgtgttccaacataaactgtcatctatattggtggatctttgcgatgctttgggttaggtcatcaaaacctaagcaaaccctggggaatgtactttatatgtatattattctcccactcacacacacacacacatcctcactgtttagaagtacacatttgtcaacattacaatgcttttggcattcacagaatctgttcaaattagtacagtgttcactactgccatagcaggaaaaaaactgtacttttgaatcatttatttttaaatcatttgaagtagaaaattctgacaggttgcactgatgaatctttactaaaaataaaggtctttgtttacaaataattacatcttctcaaccagtggtttcatgttgcttactttcttaaaattccaaatagaacaaggtttgcaaaaatcgtcacatatacatgttatcactgttgactgttttatgataatttaggtagcattcattgtacacttacaatatggcaggagcatgtggcagttacttgaatggcaatatttatgaggtttaccaccaatcaagcttcccactatacagattaagattaagacttactgaagggtccttgtgctagtaagaggcagagtaaaatagacctaggcatcttgaattcctaaacctatgatttctaagttatgtcttctggcctttgtgttaaaatttatttctaatcaacagtgatacttttaaaatatacataatagtgtcatatgtgaaggtcaaacactagtaatttaatctgtcaagtacttactgatcatctaatttgtgttaattactgggtgttacttgacttgtcctcaggttctttatgcactagagaggagacagacactcttacagctgctttaagacacagtagagataggaagtataataacttttcatataaatcctctgggaccataaattatagcttcataaatcttggcttagcaggtagcagaaggtataactgaatgatgagccttgatagtcaagtatgatttttataaggagatcatcccatagaaatattacttcactttgtggagctaaatgagaaagaagcacgaatcgtcagttcattttgtgactgttcgtttcgtgtgtagggcatatggttaggggaggaggagtaggagaggcggctggaaaatgaggttgaaggacacattgtggaggattttgcatatcatgctcaaggagatacattttattcagtaggcaagagaagggcattggcaggttttgaataacaagtcatgtgtttcaaccctgggacttatgaagctgaatggagaggcactttgcctttaggaaggattgccaaaaaaaaccaaaaagggccatgctgagttgaaagtgtcaaggttgcctccagaataagctaactgtatttggaaatcagggtttattatcaacagatcagttaagaccagtgatagaatcgcattgcaggggctagggtggagagagataacagagtaatcccaaaaagtacatgaaatttcacagagaaaaaaagtacaatcaaatttgaagaggttcaaggacagaatatttgattgattgttttgttgatcgatctatctatctgtagggaactagaggtgggagacatagttaggtacgatttaagagtttccttaggaaagtaccatcacataacagatatttaaaaagactttaaagaaggtagttatgttaaacagtgctgcaaatgaattgaggaggatgcaggtaggggaagggcaactggatctactgttttagaagtatacttgtgtgctgtgagagggatttttaagtataagtgtggaaaacaagaaataatacatagaattacggctgattatgggaaactggaaggaggaaagtttaatcaattctgaggttcagtgatgaaagtaaggaggagatgggatagttcatagaagaatgatgttaatatttcagattgggagagaattaagagttctgataaactcctaattttgatgatacactctgtggtaggaatctacagtacaccgtaaattcctgtgtataacatacaatgtgctatataaaatatgtggtatcaacctataaatgttgatttttcaggacaaaaatgtccagaaaaatgtaatgaacattcagcatacagcttcgataagaagttttaatcccattagtatttaactaacatactcccatttttagtaagtgattattattagtattgattcctacttaattctcttcaatgccgtagtctctgtattttcctcccttcattaaaaaaaaaaaatctttcaagttcaagttttatcagagagcaagatggcatagggaagagagcagagaccatgacatcactggaacagtttaacatgatttgattttataaaacatgataaaataagtatcaggcggcattttgttttaaaacacttgctgctggaattccactattcatatgataacctgctgatcagtaggactctgtctcctgatgccaagtttttagcaccttctacagcaatgtgtgaataatgcagagatgcgaaggaaccttttaagccaacttgagaaacaagccctgtcaaaaacatgatttctcatgactgaataatgcaacagactattccatttagaaaaacatcagtaaatagtctgagttttgatagtgattacattcttacacttgaggtaaaaaaaatattcttgtctcagtccacaaagttgataggcatagggacatatgagtgtatacactgagggtgtttaacaatgaaatgtgattcaaaaatataacaagatttgataagcaaatgggccagcaatttgaaatgcttcaaattatacttaggctctgagatgaaatgtatgtcatttaagtgtacttttttttttttcccgagatggagtctccctctgtcgccaggctggcatgcagtggcacaatctcggctcactgcaacctccgcctcctgggctcaagcgattcttctgccttagcctcactagtagctgggattacaggcacctgccaccatgcccgactaatttttgtatttttttttttttaaatagtgacaaggttttgctatgttggccaggctggtcttgaactcctgaccttaggtgatccgcccgcctcggcctcccaaagtgctgggattacaggcatgagccacagtgcccagccttaagggtatttttaagtagctcatcaagatgcaattagatttaccattatctgacttgagtagaaaactggaaaaaaaaaaaaaaaaaacacaaaagcagagaatggtgagaacttttaagcgaaggtgtagccgacccagtgtcaaatagacaaaatgtagaaaagacaaatattatacatgtgatcttttctgtcacataatgttgacccctaggatttccatcttatgctttcagtaacagtaaactacaatatttagtgcagtattagatgattatcatgtcctaatacatttcctccataaaactagaagaatggcacttaaggtccaatgaaatatgatggttaaatataatatttgtactcccttgttggtgttgcttaatgcatttcttaatcctccaatttatcgtgtcacacagcactaagctcaacaatttattcataaagtggctgcaaatataatttggaacaaacttttttttgttcaatataatttatttatttattgcttgtataatcacacaaaagtgtgagttccatgaggacagagacagttgtctcttctgtttactacaaacgtcttccgggccagtaataaccagaagttgttacctgttaaataaactgaaagtcaaatgtagggtgatttctacgcatgaggagttctagagctcattgatgtcatccaaggtttaaattcttagtgtaatgtattctaggctcatccatgttgtagcaaatggcaagatttcattctttttttaaggactgaataatattcaattgcatatatgccataatgtctttaatcatttatccatggatacttaaacgttgtttccatatcttggctactgtgaacaatgcttcaatgagcatagaagcccggatatctttacaaggttgtgttattttttcctttgtgtatatgcccagaaggagggattcttgggtcatatggtggttttgaattccttgcctcacaaaaccttgctttgtctttgcttgctgtttttttttttttggagacagattattgctctgttgcccaggttagagttcattgacccaatttcagctcactgcacccctgcctcccaggttcaacgattctacttcctcagcctcccaagtagatgggactacaggcacccaccaccacgcctggctaatttttgttattttagtagagacagggtttcaccatgttggccatgctggtctcgaactcctgaccattcccatcaatgatagactggataaagaaaatgtggcacatatacatggaatactatgcgaccataaaatagaatgagttcttgtcctttgcagggacatggatggagctggaaaccatcattctaagcaaactaacccaggaacagaaaaccaaataccgcatgttctcactcataagtgggagttgaacaatgagaacacatggacacagggaggggaacatcacacaccatcgcctgtctgggagtggagggcaagggtagggagagcattaggataaatacctaatgcatgcagggcttaaaacctggatgacgggttgatgggtgcagcaaaccactatagcacatgtatatttatgtaacaaacctgcacgttctgcacatgtatcccagaacttgaagtataataataaaaaaagacacctaggaatcattctcaacaactgtactgtccttgtcatatttatagtgcccacgtccaatacactctaagatcatatatgtcagaagtctgtcatctccccctctttccctacttctgttttgttgaagtcctcagtatatatctcatcaattcattttttcaacagttcttgagttcttatggcagcagtcaggttctgactattacatactgtcattcactggatatctaactggtcttgctgccctcatcttccatagatcattctccacactgcatccagaatgatctttcataaatataaatgtagtaccaatgttcatggtttgactgtcaattcccccaaaagattaccgggaaaacacgttgatgaaacaacgctgagtgtattagacatggcgccataagggaagacactaacttgacaaggtcttagtagtgtgtaaaaattcctacttctcagttcatatttcgcttcccttttcaatgcttccatttcttcttggacgtgttcttatgagagcacatatattttttgcttacttgtaggtttcctccactggactatgatttccttgagggcagctcttttattctttatatccattgtgatctaagtgagtgattaatacatagttgatacatgaatccacaatatgtgctcattttagtattaattgaatacataagacattgcttcttaagtgtgccttaattggcacaataacaaaatttgttgaggatttactgaagaccaggttcttccatgctgtatgtatattattaacatgtttaacttagcttaccaacattaggagtttatattcttgttattcccattttcagacgagaacactaaggttcagtggtacagaaaagaatttgagtctagatattttgattccacagcccatattcttaattctcggtacactacacttctctagcatgtttgataatatattggtaacactcaattgccaaatgtattctgcatatatcacaaccagtatcctgatatatgttggttgggttatgaaatgacacataatttgttcaacaaacatttattaagtttttacagtatgctagccacaatgtgagattccttatatgtactacctaaattaagtaacttaagtaaatgtaggaggatttgagacatgcatttactttcccctctttgatttctaaggcaccacacattccaggttttcttcctgtttttctagcatctgctttgattttaatttgctggttcttccccatcaacacaaattcctgatatgacagtaaccaggggttggttcttagaccacattcattttctcgatgatcttatctagcctcctggcatcaaatactgtctgtaagttgatgcctcccaatgtttacccccagctcagagctttctgccaaactccaaacttagatacacaactttttatacattcctagtcaattcaaatttaccctatgtaaaactaaatttactaacacccacatctgcttcgtcaatagtttttcctgtgtcagtaaggtttcactatagccttccagttgccccaaatgaacatctttgagtcaaacttagtcttgttctttctcacacctgatgttgttgattagaaaactatgccaggtttggccggatgcggtggctcacgcctgtaatcccagcactttgagaggccgaggcgggcggatcacgaggtcaggagatcgagaccatcctggctaacacggtgaaaccccgtctctactaaaaatacaaaaaatttgccggccgtggtggcaggtgcctgtagtcccagctactcgggaggctgaggcaggagaatggcgtgaacccgggaggcggagcttgtagtgagcggatatcgcgctactgcactccagcctgggtgacagagcgagactccatctcaaaaaaaaaaaaaaaaaaaaacctatgccaggtccaccttaaccaggtatatatccagaatctgatcacttctgactacttacatggccaccaccatcacctctggtctaaattagtgaaatagccttttaaacaagcctgcctgctttggccttgccttacctgtaatccattttgtctgccagatggtcttgttaaaacgtaaggcaaatcacatcactcttctgctgaaaaccttcccatgccttgccagacattcagtaaaatgcagtcctgctgttttataagcccatgcacaatcacctcctcctttctctatgtttcttctctggcttccttttccaccgttgttaccgtctctcattccaccgcagtcatagatgcctctacctggaacacatttcctccacatactcacatgacttactctctcatatctttaaatctttttctcaatgatattttccctagtactttcaattccccttccttgcttccttttctccataacacttacatccttctattttacttatttctcttgattagcatgccttcagtgacatgattcactgaatgagaacttagatttctgtctgttttgtatatggctatatcatcattgcctaaaatagtgcctggtcctttgtagttgcttaataaatatttgttaaagcaacactatttgtactaagtgacagagccagaattccatatgattttcaagctcttctctataaaataaatgaagttatgatgtattgaatgtataaaggctcttttgttagttgctcttctacctggcaagtctgtaattaaaataattttgtaaaaaattatctatttgaagtttttttattatttgttcaattgccagtagataggctagacaaagataagtttaccaattgattatggatatcttacattcttattaaaaagcaaaataataatggatataacacattattattttcatgattaaggatatatcacctctaatgagtagatactaaaagagccttaattttctgattcccttatttctcctcaaggcaaggatagatatccctgtgctgatggcatcgaatgcattggcaagcctaaaatcaaacaagctttctagtagactccactcaagattatcatcaatcttcctttgcaaatttggttttcagtttttgtcttcacattgaaaaatagtcaatatattggcaacaaatgtaatgcattactcaatggcaggtgatatcgctaaagatggtcaattacatgctaaaaacaaaggactttgaggtctgttggatgccaaaacctacagtcaattcagtcaatatttttgacagtacagagggaaaaatcactcaaggaaaattgccacagtatacattaaatatctttgtttatcccattttagttattttgtgtgatatctctaaatgctgttctgtatatgctgctgacaaggagcaaatttatttgtttagaaattctgcagcctttccatcctttgccttaactttcttgttgaggtactaatgagctgtgaaaggccaaatgaaagagaaataacacctccagataatctgtactctgataaactactcccagaataattgggagtttatggttgttgtagggcagtggaagaaataagcaatgttggccaactatacggaacaacccgtgttaataaatttgtaaaagaagtttacaaggcaatcacaatcctttcaaacaaatgtcatgcatgtactttcaggcctaggcacaatgttattatctgaaaagcttgataggtaggattgtattttgtcccactatttctaaatcaggaaattctaagcatacttgtgacgatttctcttttaccttaaatggcttccctattccagatttacagtttctgcatgagttttctactcaatttgcataattttaatttacctttatgttaaggtttttgaagagctgccgtactttcatatttggagtttaacatattttaatttatggacgtggcaataatttgatgacctttttagtgtaatataaagcctatatataaaaacttccaaatagaatatgtactgagtttgtaggaaatttataagtattatgcaaatcaagaatatggtagctgattccactagaggctattttgaaaatataaagaaactttgtttttaaacatagtattgattatctcactatgtgacaaaaaggtatttctgtttattctgtttctttccatttctgctttccaaagtagaacaaataagttgaaatgtaccaatgggtgtgttttaagttttgacaggtttcgggtatgattatataccaacaaaatcccagtaatatttgctgcatatttcattgtatctatattttatgtactgatttaaaatttaaaatgtgagtaaattttaaggcattgtgctaatgaaacttatggtagttcattttttatttttatatagacaagctatctgtttagaatgcaaaaattatatgccatatacaatcatattataaacatataaaattggtcacagaaatttctaagggtgaaaaagactggatgaatcaaagaaatctatccacaattctgtgagtgtatgagagacttagaatgatcacattcacataaaatataacacattattatattttgatttttaaattaaattttataaatctagctatctctgggaaatgtttcttccccttgagttattacaaaaaagtctggcaacaagttaatattcaggatttcgtgagacagatactgaattcagttcccatctctgctttttattagctcttcgaccttgggcaagtttctaacctttatgaatcaggtctcctcatagtaaaatgtagacaataatcatcccttatgttgtgaggttaaattagatgatttagtggagtgcttacaccatccctcacaaatggtaaacacttaattcactatacttcagttctggtggtaaattctaaaagaatttagatgatgaagacagcattataatttaaagcacagtctacacagtggatagcacccacttaggagatacacacgatgaactggggttctagaaggacatattataatgtctcttcacaggcttatttaagaattaagaaagaaataaactttaccaatttttaatatacaggttttcagataatttgatgtaatatatggtacttgatatcttctgtggaaaatcagagatccttaataggatgcataatgtcaggcctctctcttatttattagcgtttttggtgctcttgatgtgctgctatgtctatgaacactaaagtgtgtttatagattatgttatcttaagtagtagaatacttaaaatctttgtcagcaaaatcagagtaacctaggaaatctattttactacacagaaatgttctggacatctcatggcaaagtagttgaaaagattgagttatgtactttatttttgaaaaggtcaagtgttacataaatgctgaacattttcaggttggcaagtggctgtgagtactatgttatttctcaaattatttccaaaagcagaaaaaaaccttcaatctttgaaggagaagcttctgtattaacaatattaagaaagagactagattttataagacattcatgctatggagagagcattttaaaaatggatatttggtggtagtcccattataaataggtcagttataaaatattctatacctacagaaaataaatggaaagaaatgtcaaatctgtttaaaaatattataagtgaaaactttcagtgaggttttgtctctgtttatgactttaggacgtttactttctatgttcacctcacttagggttctgtttcgcttttctgctcatgcttccatttcctcagttggtaatatacacatatctgtacatatcctttaatcctcttctagtatcttcaccaaatcagaagtgattgctcttatcacttagcccaccctgattttgagttttttttttacttgaaaatatgagaagtaatgttagtataacaagagatggaaacttatcaaaaggtttcatacttttatttttctgaaatgcaaaagacttactgcgttcttctcagttctatgaaccctaagatcaaaagctttagttgtctatgggacacagagatacagaccctgaagcatgattactcctattaggagccaatgataaaattgaagaactttccactgctttcagccaacaggatagaggacttttattactttccttgaggcagagggtggaatttgcaggtgttaatgaaatctaccagagtcttcccaagaattaataccattctttgaaatggcaggctctgaagacctttccttgaataggaaaggaataggaagagattccaagaatctctttccttgaatagggaagccaacactgcattgaagaaggcagtaagtgaaataaacaagtggagtttgtgtcatttcttgtccctgctctgtcatggaaagatgccttggtctaattctcttaggaaaaaaaatgtcctcatatcagtataaggtaaaatggaatattgttacatgtcatatgctaagagacacattattgtattcaacaaacatatagtatgttatactgtatgtcaggtgctgaacaaaataaactgtctactgtcgtgaggcttccgagatgctacatcacctctcataaaagaacttccccatttccacaatcacacccttataattgtcttcctaattagctcactagttatttatattatttccctaattttaataatgaaactatcccacagaagcactatagatgcccaagaagtagagacaggaagctacccattagttcccccatagggatttctctcccttatgaaggatataccacatctttgtttaaggaataaggaaaagagacaaaggtatgtaacataaataaagagaaagcacacagaatttagtgatatatgtgaaaggtaacgggataaaccaagcaactggtgtatgttaaggaggtgaatatagctaatgtccttggagaaaatttacctagttagaaaagatgtgtcaatttagtagaatatttttacaacctaaaatctaattgaaccaaactcctctttattgttgttagttctctattctgggttgcactaaataaaaacaatgaggcagtgaaagtgattttataaaagttgaatggcaaagggtgatgctgaatgtcaatacaatcgctgtatgttgtctgtgagccttacaattaccctctaaattagtatcatatctattttcaggtgtgtaccaagagtgtgaaattaaaaaactttgccaagttcaagtacacactacctataaattccagaacctgaatttgacctcatgtttattttactccaaagtgaggccgacttaaagtttcccgaatgcggccactggttttatgcagcatgatttctttgagacattgttatatacagcaatggaggtagggcagggggagggcagtgagatttcagagatggctagcttggacatgcaatagagtgggaaagtgacccaatgagaatcaattggagggggagagattggagagaggaaagataatcaacagtgagaagttcagagaaattagtttaaatgtgggaagcaatttcatcatcaggagatagcaatctatggcctgagggtgaaaatagacttgctacctgatttttgtaaataaagttttattggaacacatccatgtttattcacttaatgtattgtctccagatgctttggggctacaatttgcagtgacagagctgagttgggggcatctggtctttagtggtctgcaaaattgaagatacctattatctagccctttacagaaaaaagcttaaggttaaggagtcttggatcaaataacaggaagaataagattttcactgaaattagtgtaagtgtagataagtttctatattttggggacatctcttgtgctaacttctaatttctttacatatagacttgtggaataaatgagtacatagctaagaatattataaatgatgagaaaaaaagcaaaattccaaaacgggctacatgggaatatttatgtttaggttctcctcatagctcacaattaatttgtatatgcaattacaaactctatggactacggtcattctagaggaatattatttaagtgcagtatatgtcaatttgaaataataagttttcacgagatatgtgtattttgttttgatttttttggtatgtaaaaaccacttgtctaaagcagtttacttctgaattattttgcattttaaaagtatccagtgaatcatttttttcctatttataaatgactgattaaaataaataagacttggtgtttttccatgagacgtatttgaaaattaataaaattgttaaacttaggattaaggaaaataacattaagaatttatttggtcttctgagacattttgtaactatcctattttaaattaaatttagtacttttacaaaatctcgtttcaattaccaactcatatgaattccaaccaaatactgacttttaaaattattgaaacatccaccaaacagtacagagttattatgttcatccttcttctctggacttcatgaatctctgtcagccaaggaatgtcggtttgtttactgggtatcccatttttcctcccacacctcataggtgtgacttggatttcctcatcctcatcttggaaataggtccccccttttagggtgtttgtaagaattatatgaaacagtaagaacaaagaaatcactaggctagacgtctttcatgtgccatctaataaatttctgagaaagtttttttattgatgcttatgaaaattttattataaacttgcttttaaaaagaaatcttttatattgggttattaaattgttctaggtacatttctctaaatcttctattattttctctctgaccttccattgatttaggagaatttgccataacagtgcttatttctttttcttccttcttgattttatgagaaaggttctattgtgtggattataatagccaagacagaaagtctcaggtgaagtacaggaaaaaataaaggaataaaatataaaataagttagaaagtaaatgtatacccaaagatataaatggtagaattagagaaattagaggaagaaaacacacacacacacacacacacacacacatataagttggtatactatatatgtatgtgaatatgtatatatgtataaacacatatgaaatatgaataggaatattgggaagacatatatttgaaactatgaatattttatgccatattactccattttcaaggtattgattggttaaaacatattttatataaaacctgaaattggaagcacaaatgaccttaaataagaaattaaaattaccccaaacaatttagtaaatatttattatctgtgtactgtgctgttaggcacggggtcagtgtccccgccttcctacaatgcaagggttagtgtaatatctaaaggtatgtgacttgaaaaacgatgaagcaaaatgactggaaccttcattgagagtatgttttagagagacagagtagagttttagagagacatctgattttatagtagaaagtttattttaaactcacatataagcttttacagatacatttttatagtaaaatctcagctgctagaaaattagagtatatcagtatatgagattgctgtaggtttcgtggcactaacaaaaacacaaggatggatgaactaaaaaatgagtttgtttctctttcagacttacttctcttaaatgttgtgtagatgggagtgatggaggccttgtaggaagtctctgctcattcagggatccatagtcctgttgcccagtttttcgatcatcccctgggacgctgtcttcgtagtcacggttgaggatagctcaccagcttcatgtgtgtatcacgaccttcaggagggaggacgaagaagagagcatatctatgcccatttacgtcttaatgacgaagttggatgcgttatatccaactggccaatacttggttacatgccacatctaactgcaagggaaagtgggaactgtagtgacatttctagatagccaaattgtcccctaaactttctaatactacataaagggtgaagaaagatacatattggaggatgagcaatctttgccagagccatttttttaatgtaggaattaagattaatgtttttcaaaaaaaggcaggggttgcaatcctagtgtctgataaaacagactttagaccaacaaagatcaaaagagacaaagaaggccattacataatggtaaagggatcaattcaacaagaagagctaactatcctaaatatatatgcacccaattcaggagcacccagattcataaagcaagtccttatagacctacaaagagacttagactcccacacgttaataatgggagactttaacaccccactgacaacattagacagatcagtgagacagaatgtcaacaaggatatccaagaattgaactcagctctgcaacaagcggacctcatagacatctacagaactctccacccctaatcaacagattatacattcttctcagcaccacatcacacttattccaaaattgaccacatagttggaagttaaagcacccctcagcaaatgtaaaagaacagaaattataacaaagtgtctctcagaccacagttcaatcaaactagaactctggattaagaaactcactcaaaaccactcaactacatggaaactgaacaacctgctgctgaatgactactgggtacataacgaaatgaaggcagaaataaagatgttctttgaaaccaatgagaacaaagacacaacataccagaatctgtgggacacatttaaagcagtgtgtagagggaaatttatagcactgaatgcccacaagagaaagcaggaaagatctaaaattgacaccctaacataacaattaaaagaactagagaagcaagagcaaacacattcaaaagctagcagaaggcaagaaataactaagatcagagcccaactgaaggaaatagagacacaaaaagccctttaaaaaatcaatgaatctaggagctggttatgatcaacaaaattgatagatcgctagcaagactaataagaaaagagagaagaatcaaatagatgcaataaaaaataataaaggggatatcaccaccgatcccacagaaattcaaactaccatcagagaaaactgtaaacacctctacgcaaataaactagaaaatctagaaggaatggataaattcgtggacacatacaccctcccaagactaaaccaggaagttgaatccctgaatagaccaataacaggctctgaaattgaggcaataattaatagcctaccaaccaaaaaaagtccaggaccagatggattcacagccgaattctaccagaggtacaaggaagagctggtaccattccttctgaaactattccaatgaatagaaaaagagggaatcctccctaactcattttatgaggcaagcatcatcctgataccaaagcctggcagagacaaaacaaaaaaaagagaattttagaccaatatccttgatgaacattgatgcaaaaatcctcaataaaatactggcaatccgaatccagcagcacatcaaaaagcttatccaccattatcaagtgggcttcatccctgggatgcagggctggttcaacacacacaaatcaataaatataatgcagcatataaacagaaccaaagatagaaaccacatgattatctccatagatgcagaaaaggcctttgacaaaattcaacaaccttcatgctaaaaactctcaataaattaggtattgatgggacgtatcttaaaataataagagctatgtatgacaaacccacagccactatcatattgaatgggcaaaaactggaagcattccctttgaaaactggcacaagacagggatgccctctctcaccactcctattcaacatagtgttggaagttccggccagggcaatcaggcagaagaaggaaataaagggtattcaattaggaaaagaggaagtcaaattgtccctgtttgcagatgacatgattgtatatctagaaaaccccattgtctcagcccaaaatctacttaagctgataagcaacttcagcaaagtctcaggatacaaatcaatgtgcaaaaatcacaagcattcttatacaccaataacagacagaggcaaatcatgagtgaactccattcacaattgcttcaaagagaataaaatacctaggaatccaacttgcaagggatgtgaaggacctcttcaaggagaactacaaaccactgctcaccaaaatacaagaggacacaaacaaatggaagaacattctatgctcatggataggaagaatcaatattgtgaaaatggccatactgcccaaggtaatttatagattcaatgccatccccatcaagctaccaatgactttctacacggaattggaaaaaactactttaaagttcatatggaaccaaaaaagagcccacattgccaggtcaatcctaagccaaaagaacaaagctggaggtatcacactacctgattttaaactatactacaaggctacagtaaccaaaacagcatggtactggtatcagaatagagatatagaccaatggaacagaacaaagccctcagaaataatgccacatatctactactatctgatctttgacaaacctgagaaaaacaagcaatggggaaaggattccctatttaataaatggtgctgggaaaactggctagccatatgtagaaagctgaaactggatcccttccttacacattatacaaaaatgaattcaagatggatcaaagacttaaatgttagacctaaaaccataaaaacctagaagaaaacctaggcaatacctttcaggacataggcatgggtaaggacttcatgtccaaaacaccaaaagcaatggcaacaagagtcaaaattgacaaatgggatctaattaaaccaaggagcttctgcaaagcaaaagaaactaccatcatagtgaacaggcaacctacagaatgggagaaaatttttacaatctaatcatctggcaaagggctaatatccagaatctacaaagaagtcaaacaaatttacaagaaaaaaacaaccctatcaaaaagtgggcaaaggatatgaacagacacttctcaaaaaaggcattgatgcagccaacagacacatgaaaaaaatgctcatcatcactggccatcagagaaatgcaaatcaaaaccacaatgagataccattgcacatagttagaatggtgaacaataaaaagtcaggaaacaacaggtgctggagaggatgtggagaaataagagcacttttacactgttgatgggattgtaaactagttcaaccattgtggaagagagtgtgcaattcctcaaggatctagaactagaaataccatttgacccagccatcccattttatcccattacagtaatatacccattactgggtatattcccaaaggattaaaaatcatgctgctataaagacagatgcacacgtatgtttattgcggcactattcacaatagcaaagacttggaaccaacccaaatgtccatcgatgatagactggattaagaaaatgtggcacatatacaccatgaaatactatgcagccataaaacaggatgagttcatgtcctttgtagggacatggatgaagctggagaccatcattctcagcaagctaacgcaaggacaaaaaaccaaataccacatgttctcactcatgggtgggaattgaacaatgagaacccttggacacaggaaggggaacatcacacactgggtcccgtagtggggtggggggaggggggagggatagtattaggagatatacctgatgttaaatgacgagttaatgggtgtagcacaccatcatggcacatgtatacatatgtaacaaacctgaacgttgtgcacatgtaccctagtatttaaagtataaaaaaaaagattaatgtttttggctctagaaccttttgtttaataggctatagaatgagatttttaaaaactaaaataccccatatgtgtacgtatgatacccatttttgtcttcttaactggagcatcggaggcacaatgtagcatttctgtgagtggttctgcaatagtgaagaatgttaaatttgctgacatttaacatcaaaggcaaatcatagggattaacagaaggcgcagagttcgaatggtggacttgacacatgccttcttttagaaagaatttgttagctttattttttgctcagcttcttctgacttctttttctgtttatgtttttaaaaaactgttaaaattatgttttaaatttttgtggctacgtagtaggtgtatgtatttatggggtacatgagatgttttgatacagacatgcagtgtgaaataaggacatcatggataatggaggatttaccgggtctgtactaccatctgggctgtgtcccattgctgtctttctggtattctggtatcttcctcagtgtgatatcagtgtctgtgacttgcgtgcattatttagacttgacatttgatttcctactcagcaacgtaatgaagacgaggtattttcctagtagcttccaaaccattgattgaatttgtggaaattaagaaaaaatacactttgacttatttttaagaagttacgtgagggccggacaccgtggctcacacctgtaatcccagcactttgggaggctgaggtgggcggatgacctgaggtcaggagtttgagaccagcctggccaacgtgttgaaaccctgtctctattaaaaatataaaaattagcccggtgtggtggcttgtgcctgtaatcccagctactcgggaggctgaggcaggagaatggcttgaacccagaagggagaggctgcagtgagccgagatcccaccattgcactccagcctgggcaggaagagcaatactcaatctcaaaaaaacagaaaaaaaaaaagttatattatatttttttaaaagtgctgttgcttagactcttaattcattttcttcatttaaagagattgatcatattgggataaagacgtgttttggaatccaaacaacctggttttaagtcccagaaccaccagttacctttgtgacctttggcaagtcatctaatttttctatttccatttcctcatcctactaatttctatcaccctgatctgttgtagtgaaaaatgatataatgcgtgttaagtgattagcaaattgactgacactaagtactcaataaataatggcagctgttgttattgctgttgtatatgcggtagtagttgtatttgttgttgattgttgccctaacagcaggccatgatttttcctaaatcctcattagggcttaactttgaactcaatttcaggccctatctatattaaaaattacctatttaatagtgtcattaggttgaatgtcatgtacagtgttgcatgatggattaatttctcataaatcacttcagtaatcatttttatgctttgaatagtaccttggtttacgtgttatatctgtgagaaaacacagcggaaatgtgtcaagaatatttccaggtactaatcctggttgttcagaaatgctcttctgttatttagtgaaagaaccgcttggttatccctctgtaatcctttatcttggaaataatcttttactgaggggtaaaaagattatagaatacaccaaaaaattcaccatccatgcattgacttagactccatgaaaaagaagtatgatacatttaaatgaactgagaatgataaaatttgcaaatgttcttgaagcatttatgcattcaagaccaataaaactgtttttgatccaggttaacagtcgtatcatactttaaggctgaatttagataaattgccaaaatccattttatcagtgatataaaactgctcagtgatagactgtgccctctcatagtgtcccagctattttttctaagagctttgtggtttgctgggctgctggtttcactacctacatgtagccacttgattacttatctcagtttgaattgcccaaatcatgcttccagaaacacacagagctcattcacctgtttccccataaaaatcatttatcatttcaatgaactttggcccccaaacacaggcattgcagagcatttcttgggatctagaatgtgcttagcattttatatgcactatctcatctaatctttccagcagccttacgtacgtatatttttatttttcttgttttatagatggggtaactgagatgcagagaggttaaatacccaagatcagacagatagtaaactggattttaaaatatatttatatattcagaagtatcaaggctattgctgtatacttcattagaaccatttctagtcagagaaattctacgagtagaaattatgactagaaattgtctccagaaatgagtgtctagagatttttctagacattgctggactaaaacagtcatttatcatccctgatttttttacctttctcctttctgctctttcaccttttttttttttttttttttttttaaaagagacggagtcttgctgttttgcccaggccggagtgcagtggcgctttctcggctcactgcaagctccgcctcccgggttcacgcctttctcctcctacctcagcctcccgagtaactgggactacaggcgccgccaccgcgcccggctaattttttgtatttttagtagagacggggtttaaccatgttagcgaagatggtctcgatctcctgacctcgtgatccgcctgcctcagcctcccaaagtgctgggattacaggtctgagccaccgcacccggcctcttccaccttttttaatgagcgatgtcttcaaggaacataggtgacaatatctaatacttcctaaatctaacaggcagtaattaagcctctgaagtctgtggataacgttgaataaatttgagtgtactcaattttgggggaaaaaaaaaaaacaaaaacagaatcgtttcatccattcactgtcatgcctctcatcgtaatcattatttgcccaatgtactgaagagaaacataaactactgtgataaagacaaaataggattgaagcataggaaaaataattagttccagttgatgatactggcatcttcattcatgaaacgattggggtctatctttcttataaatagatctataaagaacaaaaaccaactttcctagaaaatctcttcatttgatgccatgacatgtatgaagtgatctccaatcttaggtacaatgtaaaattctgtgatgataaaaacatattttggggtgctgaaacaaagcataagccactttttatatctttatttccaaattctcagattaaacatcgttttattttaaaatgtcttttattccaaggtctctatggaaaatatacaaatgtagaattcaggcaaatttcttttttcgtcggtttgcttagtctgaaattctagagccatttccaattttgttttacaaactgcagaaaaaagtttaatctcaccttagaacatatatacatatacatatcaaaataaacccatatgcacatctgaaacaaaaattgagacaataattgttagtattatataagtgacacagactactatttttctgtttaattttaaaatattcctagtcataacctactaacatgattttatgaaccatgaatggattctgacttacaatttgaaaaacaatagtctatctagacaaataattactcagatcttaaattcaaattttgattataattctgtatatatatagttgaattgatggatataaatataaaattttgcatagcttattcagatttgaatttatctttaagaaggctgtctttgaaatgtttttgttttatgcacatcctcagacaaaatatttaggttcagaatttgagtactagatgtcatgtccttgagtataagtatacaccttttaatattttcttccaaaattcaatcctgtgtaaatatcaataaatcataaagtgtttaatattttgattcaaattgcacagtgtaaagtattgtgttacttgagtattagtgctgtttacaatgcttcgtttggagaagattatttgaactcaagatagttaatgatttttaagaactcttaaatacgagctaggttaaggttcagatttcaaaaagagttaaataatgtttgctcttacacatttttgggggcgtattttcgacaataattttccatctcctgaaacctgaacagtgacttaagaaggtaatcttggggcaatttatgcttcaaaacacttcttatatatgcagaggaatttgataataattacagccgtaacatactttatttagttgttatacaaggtcactctgtgaagtgcattatgcactctttaattcttaccacaatcttattatggaagtattattgttcccattttacagaagcagaaactaaggcttatgcagggctaggtaactcccaaagtcacaagattccctttctttctatatcatcaatttcagcataagtggttggttcatataggaacataacaggagtaggaaaggatatgatagggtttcttggtcgtttgtattttcttgaaaaaattgccttcttgctgcatttgaagcagggtctggttcagataggaagcattatctcccagggctgccagcaaccttgtttactcagttatagacataacacacttacgccatattctttgaatcttactaaacttactgtgagctcaccagacttctgtgcttctagggcattgaaaatgctatatgcaaataggacagatacacatattataccacctgtctcctctgcgcatgtgcatccttcattgcacataggacttcacttctaaaacacaaattcaaaaataaaattatttacaatttcaggatagtatcagcagataatagaggcatgtgtttcttctgcgctcagggccctgtgcaactgctcaggttgcacaaacgtgaagctggttccacctgcgcacatctctcaggctgcctttatatcattttcccccttaatgctgactttgatagttattattaatagtatttagagacggaagagatacaccatggaagttgttctaacccctaagaccttcagaaattgccttactgttagacaagggttccatgcaaatagccctttcagtgcacttaccctctttgatatgatgaagttcggtgattttgacttaccaggatgacctttctctgccacttttatagaaactggaaaaagagtgcatcatttgatgaaaatgtcattgcaataactgccactatgccttgtcatctcgaaggacttaacagttggggaaatttaaaatattgaattttcaaaatttgagcatttatcagaagagcacaagtaagttggtgctggcagcttagtgggttaattcccagaactgagaaggacaggaaatgtagcacatacacaccaggggaaagccaccaaaggttgaattttctctgggtgagattatgaaatcccccaaacagcttctgttgttctacactgctttttgattcctttacaaaaccctgtttgttagggggccccgtgcttgcttgcaatatttgtggaatgcagaagattcttctacaaatatttctccaatatttgtttgttctgctcacctccgtaaatagtatgcctatgtccttgacctcagcaaagtccctcttgagcatgttctcaggatttttgaagcccggcgacctgcaaggagtacactcctcccaaagcaaaacctcctgcaaacttagtagtttactcaaatttttgcccttgataaatgcctttaggttaaagcagcagacatgtagtttatcccaagaagcctctcctgtcacttgagtgtatggttcctatagcatgcaaatctctgcaaacatatggccaggtttacagctcatgtaaactaccccgtctctattacttggcttcagatggggagaagttagagccacgcagagcgctccagcctctccagaggaagcctttctcaccagatttttctaatcgacctccttgcttgctcttacacacctttaagctagatattggattaagggttgtgagaccaattttgtgatcacttcttagcaattttttaacaggtaccctggatcttctctttagaattatggatgcttcgtacactttgctcttggctttagggtccagacggaaattccaagacaaccatttgcattctcacttaatatcctgctaattaaattgggtaaagcatacttcatattttagttcttctaagataatgtcttactatttaaatcgtggccttctggaaataaaggctaaatcacagaagtcattatgctgttagaaattttagatgggtgggtgaggtattttttttctttctaaattttgccttcctttcccctacctccttgttttcttactgatgcctttactggtctgtaaatatttggaaatatttcattacctagggcctctcaggaagagatatttcctttaatgccattgcagaggtatgtaaatataattctgataatgtatatgtaagttattataaataagaaatgaggaaagttcctacagatcaatatttatagcatttaaaaagcaacatgaggtgatatactaatttactccttccagtaatctagaagagctttaatacaatattaatttggtgtggattttgaccgctatttgaaaattgatgtatgcatgaggaagttaaaatgaaaactccctattgtctgtatctgctgttcctgtgtttgataatgccagtggacagtcctagcattttaaatatttcattcgattcatcatttaatgtactggaacaatctgcaaagacattaattgtgtaacacccaatttattttattgtgcagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggtaaactaaaacgttaatttacaaaacaaaacatatgacttgttataatggcaagtcatcctttttcctcaattactctcttacatccttgtattttggaaatttagttactatgatgtgcttgggattccaacagtcagattttgaagttttcttttggagagcaaccattgaaggcatttctacctgatcggccaacaggaatacgaaagcccaacttctttctcttgtgtcaaggcagtgctgaggcattacttacattcctgagttgatgtatggtattgggcttaacttctctcagtgggagacttttcctgagatgatacactcgtttggcttctttcccttccctgtcctttttcctccatcttcaactcccttgcggaacttcctgggagctcttccttaataaatcacttgcactgaagtccttatctcggggcctgcttctgaagaacttgacttaagataattttccttaattcatattaaaagtggttttgggattctgcaaatacaaattaaattccttttactgggaatataaatctaaatgggccacaagtttaaaactgcaaacaaataaaactcaaaaccacaccgatttacctagagttctaattacaattgttaacttccttctttgtcaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaagtaagtccttatttgtttttaattaagaagactaacaagttttggaagcttgtgattattttgatgtggtttgatggttaagttacgattctcagtttgttcccaaggcacacagctttctttcaagggagactggttggattttcatagaaataacattttggttttcacttttgtaactaaaagagcagatgttagatagatgcactgttatctacagaactatgttttaagatttgccaaaattctgtcatagttattattttctaggttttcctccaaacattaaaatgtcactataaaaggcacagaagcatgcacaggagattgtgtacataaaatcacctattagctatagttgacacgaaacttctcttctgaagaaaaagcccttgaaaatattaaagagttactcatctatatatggaaatcctcttgaaaaacattattcaaacgttttgggaaattcttattaaaatacagtatggctatgaattatcttaagaatatatattgacttaataaaaaagaggatttgagacatttctgaaaaatgacatatttcttataaaggtaacaagcagatctcatcattctggatatgtgttttgatttatattgttaggtgtgtatattcatgtaaagcctatcaagacaagatagatttatttttaaatgaaaagaaatgaagtgccaactgtggatttgaatacattaagtgaaaaaaattgtccaaatgccttaagtttatttaactattatttatgaagttcaaaagcgttaaaaaaaaaaaaggaccaaggaaactcattagatatgctagaaggattggtattccagtactaaattatagtgtgaaattatggaggggaaaaacacatttttaagctcaggccttttgaaagaataaataaggtacatgtaagatagaggtttcataactatatatgtattccaagccaggagatactaatctatgcatattgatattattcgcctgctgtgatcgtggtgatgattgtcactacccctagatgtgagaggtacaataatcatattataactgttgagtctgcccactccccagtgtttaccaggtccactaatttactccatctattatcgatattaagatataagctgccttctgtggtcatatgccaacattcttcaggttagaacttctatttgcagtgatctgtggaacttaaagcaacctcaaacaaaattagaaagttttgaaaatccaaccacctctttactgtccttgccataatagccaccagtgtcttctcctttgtgcactctaggtttccatcctctcctggaggctaaatgctctcatttttcttacactccccattttcaataaaactaacaatatggcattaattattcatactaatcagttaattaattgctgtgtgaaattgagttgcaagaaaatatgaattcctcctggaattaaaattgcaactttttctttgcttatctgaaacataaaaaaagtcttttatctgtgattctaacatttaaaaagatgttcattcaaaaattccccccttcaagggatgtctgccattaagtgaaggatgacagacacctagacttctgtgcgtgtaatttcctcatccccatcccactagagaatggaaatgctaaaatggcagtattaccacctagctgagattgacataaaaaattagtttgtccttagggaagattcaagagcttttgtacgtgttacagcttttagaataattattaagaaggcaaggagagccttctagctggtatagcttttgctaaaacatctcacagagtttttaaaatgagacacgtacatgtaaccacttctatcacatagacttttctggaaaattccttaaaaatgaatatacaaagcattatttgagcaacacaaattcagaaataatatgagagtttataaataacagtcttccttgccactttgactatgtatgtgttcgtgcataaaacctattaaattctaatgtgataagccattatgtaagctttgctgaacctgatttttgaaagattttgtgagaggaaacaaaaaacgtgattatgaaaagagggtattgtcattatttttaaaaaactaatctaggttttacttaatgcttcaaataaattataacctgttcagtttccattatcatggtcatgagaatggattatctccaatgattagcttcaacttggagcattacctattttttttctaaatatatgattacttcagagtagaagattactagtaaacaaaaatggattcatcgatacttcttttctctctctacctaagacagggtttggatagatccagtcggaagccattatttcctgcctaagccttggtttagcgattagagaaatgataattaacatttgtctagtcatattaagtatatccaaagctatgctataatttctaagttgatataacaaaagttaaaaacttcttgtaaatacagataagcttatcactaaaatctatgaacatttacacttagcaattattaatcctatctaccaacatacttactattaggttgctgcaaaagtaatcatgtttttttccattgtaagtaatgggaaaaactgtaattacttttgtaccaacctaatagcaacatcaaattatatttgatatatagtcattgtgagatatatatatatatatatatatatatatacgtataaaatacacatatatctctctatatgaacaaatattaatggaatacattatcaaaaacaattaatggcactggagactcaataatgatcatacaaggtctggccccagatctcatgaaacatattctgtagaggctggcagccaagaaaaaaaagaacacaagaaaaataccggataggaatatagtttttgaagagattaaaatgtaatgtgatagagaatggttgaggggaggctactttagactttgtgatccaggtaagactttgaaggttggtaccatttagtttgagatttgaatgacaagaaggtaccactatttgcagatcacaaggaagtgtggttcacggattaggaacagctaatgcaaaggcccaaaaatagggacagtttggcttgctggaggaaccaaaaggccagggggactgtagagttgcagggtggtaagttagatggctgaggtctgagatggggttgaaatataggtaggagactgattacatattgtagtgtcagtcagggctttgaataagggctttgaattctagactaagtgcaagacaaagccatcagattttatgtaggtgagagataggtcaagaaaacctatcaggaaggccactggaggaagagaggacagttattaggccagtgaagttggccagttaagacacagtagtgtcttagaccagctggtagttgtgataaaagtatactttactatcttagccatttagttattttaaaaaccacttctctgtttagttttagttcctatttttttttccttttgacagtaaaagtgctttttcctttggaaatagactgcttcaatttgtgcccacagttactattattcaagttgcatctaggaaataatatttatcccataaaccatcaacaattatgcaaaacaagaaatattaaaaatacaaagataatagcgtgccctgatttctgccttacataaaatcctctccagtttgcctaaggaataagggcttgctttctcaaacacttatttatgtgaactggggcaatatacttttcttttctgttctctactttatagttttgtaaaacagcaatagtgtcatgaggctgacatacctctgaaagatactagatgagatagggtataaaaagttagtttgtgaatgcaaaattattataaaatgtgaagaaagataactgtgataaataagatgatgagctgtcagttaactattttaccataccatgtcactttttatatgtaatttgatattttctatatgaagtattatataattttatatataattatatttcatatattttgtataataacttatatataattttttaacttttaaaaaaattttgcagggaatgaggtcttgttatgtttcccaggctagtctcaagctcctggcctcaagtgatcctctcccaccttggcctcccaaagtactagtattacagacctgagctaccaaacctgaccctcatagatgttttttactttttttctccagccttttctaattgcctcagtcatttttttttcccaaagagtatagctgtggttattttgtatggggataagggagcatgagcaggatgattagaaatacatttgcagttattttttcacaatggcaacatttaaaaatatgcttacaaaggaatgtcaggaaagataaccatacagatacttcctcctttctttctccttcataaccacactctcatttgattctttccttgctattgtattttccctccaattctgttgcttttatggacataaatttctgatgaggtaaaagctaatacaataaagaagtttattaacacatctccagtcacaaatgagtttggcacgtgccgatactggtcaattacaaaactttaccaatgtttatatgatttaaatgagaaaactaagtgccattcctttcataatgtagtgtttaaaacaagagaatattgatgtggttttgttagaaccccttaagaggagtaagccaatgattttttttttaatgctgtggaatacacttgggatggtaggaggtaaggaattcggaagaaaaacacacaacttccaactgtggaagtgcaagaagacaactggcacagggaaaacagaagattttcttctctatgaataaactaattaatttgattgaaaaatgcaacctgcagagagcaaaaaagatttactgacatttttataaggactcaaagttaagcacagcaagttccatcaacttttctgataattgtagttaggacatgcaggcagaaactaaaacttctgtgacggtaagggaaaaaaatgaaagcaagtcaggaggccaagtgaagttgtgttttttggtttatatcagcaggaggagagatatgaatagtatctgggtagatacacaagccataatatggaaaataattgtgaatcaccatcaatgctttgactggacagaaaaatacatctaacaaatatggctcatctctttttttttcccccaagtgtctatttgactctggaaataagatggcatatgtgagagtggatagagaaaaggaggtgctgaacaaatgagtgggttattttctcccaagtgcagtgaagtttgcgtatgtgaatatatgaatgaatagatgaacaactaaattaagttattcaggtaattccaatcttggaattgaattcgttgcagtaaatactttggaggtgcacaatctcaaactcctaattgtgattttatttcacaatttggtaagttcattgatttttctgttttacttcttccagtaatgttaagcaatagtaacttgcagatcaaggtggtgtaggaccagtagcatcagcgtcacctgagaacttgttaaaaatgcagactctcagctctcattctgatatatacagaatcagaattgtgcagtttagcaatatcccaggtgatccctgatcagtttaagtttgagaagcactgatctaactgaaattaagacagagtagaaatctcaacttctttgtaaacctctacttagatatcttctgttcctatttttctatcaagtgacgtgggccaaatattttaattactttctcaggagctctaaaaatggtgctgatatttcattcagtcctcatatgttgatatcataccccatgggtgattaagcagtagcaagattctggtgcaataatatataacagacaatatatgagtgttgatgagtattgataattaagctattggactaataagaagtaggaattatttatagatgataacgtgacattcggttaggttgcacatggattatggtcataataatttttctgtcaataattaaaaatgtgataatgcagctaaatgtggacatctcttgtactaataatacaatgcatgtgactcatagtttaaattacaggaaagctaaatttctggaattcacagaaatgagagagccgtatcttcaaaaacaatgctttctcacaaagataaataatgctgatatggtttggctcatcttgaattgtagttctcataatccccatgtgttgtgggagggacctggtggaaggtaattgaatcatgggagtgtaaccctcatgctgttctcatgatagtgagtgagttctcacaagatctgatggttttataaggggcctttccccttttgcttggcccttcttcctgctgccatgtgaagaaggacatgtttgcttccccttccatcatgattttttctgaggcctccccagccatgccgaactgtgagtcaattaaacttgttttctttataaattatccagtctctattatgtctttaattagcagcgtgagaacagactagtacagtacattggtaccgcagagagtggggtgctgctataaagatacccgaacacgtggaagtgactttggaactgggtaacagccaggggttggaacaattcaaattaaactaatagactatctcagagagcagatttaatagaagttgacattttaatcttagtacaaaaattcccaatcagaaatatcaaaactatgtcttgttcataattaagttatactacttatacattgaagaaatatttattgagtgtgtagtatgtgccaggcactgtgccagatgctatgtagtggcaaaatttttgaagttgagagtgagcttctatttccacataaatgaatagaatttcagagtgtcaacattacctattcttactagagataatttaaacagtcttccaaacgtgatatattcatatttgtccttggctcctgatgacatctgccaatttctttattttctttaaaagcatttaatcaggaagattgatttgagggttgccataatgtatttgccacaagaatctttttctttttctttttcttttttttttgagacagagtctccctgtctcccaggctggagtgcagtggcgctatctcggctcactgcaagctccgccccccgggttcacgccattctcctggttcagcctccccagtagttgggactacaggtgcccgccaccacgctcggctaactttttgtatttttagtagagacggggtttcaccatgttattcaggatggtctcgacctcctgacctcgtgatccacctgccttagcctcctcagcctcagtgctgggattacaggcatgagccaccacgcctggccaagaatcttttgcatccagccacgcagcttctttatgttattgttactaaactgaatttatgttttcaaaatgaaaataaatgtgtttgcatttgaactttaatgttgcctcggatagttgaaaaatattaataattaaactgttcagctatatggatggaggacaaaaatggatcaggatttgaaaacaatgacacattttcgattttctcatagaattcagtataaaaacaatactatttctcacattccattaagtaggaaaataaatgttagtgcatgtttaattttgtgaaaaactggaacattttccttcatttctagttgttggatggggaactttatattaggttctttctgaactatttactgtgaggttgtaatttaaagtttgacctccaagatcaggttgcagggtgcagtataataactatggcaattagtgggaatttttgaaaatgatacatgacatgctctccttggcttctttcctagcccaagatgtcagcatacttcgtgttgggaaagaaggtgctgtaaagaggagaatgaacacattagttttagggggataaaaactgtataattttgtcagaccttgcctcacttcattctccaatggaaactactatattagtgcctaagatttatacacaccgtgacaccatgcagtgtcaggctttgcagctgagtctagtaaggaataccagaatttggaggaaagcagatctagttactgaggcaagtaggtaaactaggccagtagggtttctacagcttcacagatgctgagggtacccattcagaaagttagcatgagaactagaggacaatagcgatggatgtacttgtggtaaaggtgatgagatagtgaaaacagtgacagctgaagtcttacacatttgagggggtaattggttctgtttggattctggctttaaagcttatatttcacaggccacttattgaactttgataaacgttataaatcttgggagttgaaaaatactaatatgcttcctatggaccattcattattgccatgcaacaacaacaaaaaactatgtgcatatgtttgtacatgcactactcaagcttttcttttaaatgaatgttgcttttctatattaaaacatgtttgccatttcttggattataatatatcatgatttctgattcctatatttaatgatacaccatacattttaaaaatatctagtcattttatatggtcaccatatatttgagggaaaatgagtctcgaagtttattgtggaggaggtggagaaaaatcgccaaacagaagcctccagtaattatccctgttgcaggaacatcaaattgaacaactgtccacactagaaaagcaccttcataagagtgaaaaattaggtgcatgatcgtagtacctggtttttgggttgtatcacagaaagaggcacagaagagggtagtaaaggcaatattctatcacctataccagctctccctcatccatggcagcagtcacatggcatgaagagagagtctatgtgcttgcagaagggagattgcagtgattataggactttgcattgaaaatcagtgctgccctgtcacagtggaaaccgacaaagaacagaactcagccaaatcccgcagagggagcatttagatgaaccctagacagggaagaatcatccatcccagtgtttggaacctgagttccggcaagccttgtcatcatggattagagtgctctgtggttctaaataaacttcaaaggtagtctaggccacaaggactgcagttcctttgcaagtcctggtgctgtgccgggctcagagtcagtggacttgggatacatacaacctagtgagacatccgctggggcagctaagggactgcttgtgcttcccttcccccaaccccaggcagcacagctcacagctccaggaaagactccttccttccgcttatgaagaagagaggagacaagaaagagaactttgtcttgctgcttggataccagctcagacatacaataggatagggcaccaggcagagtcttgaggtccccattccaggccctagctcacagataacatttctgaacacaccctgggccagaagagagcctgtcaccttgaagagaaggaccccgtcctggcagaattcatgacatgctgaccaaagggacctagggccctgaataatcagcagctgtagccaggcagtacttgctgtgggtattgggtgagactcagagctgtgatggtttcaggtgtgacccagtacattcccagctgtggtggctacagggagagaatccttctgcttcaggaaaggagaggtgagagtaaaggggactttggcttgcagcttgggttccagtttgaccacagtggggcagagcatcaagtgggctcctagggtccctgattccagagtttggctcctggattccattttcttactgccctgaagggagagactcaggactgacagcattcaccacaggctggccaaagtggccttggcccttgagtgaacattggacctcagacagtactctctttggttcagtagtcgtcgtggccatgaggagagacatctctgtttgtggaaaggggagagaagagagggaaggactttatcttttgggtggggtgccagcttagccacagtagaatagagcaccaggtagatttcttaggttcttgagttgatatagtttggacatgtgtgcctgctcaaatctcacgttgaattgtagtaatctgcagtgtttgaggtagggcctagtgggagctcattggatcatgggggcaaatttttcataattggttgctactgtccttgcaatagtgagtaaattcttgcaagatctggttgtttaaaagcgtggcaccctccctctcactcttgctcctgctgtggccatgtgatgtacctgttcctccttcaccttctgccataattgtaagtttcctgaggcctccccagcagctgagcagatgccagcatcatatttcctgtacagcctgtagaactgtgagccaattaagcgtcttttctttataaattactcagtctcaggtatttcttgatagcaatgcgagagtggcctagtacagaaaattgttaccaagaagtggggctttgctgtcaagatacttgaaaatgtagaagctgctttgaaattgggtaacagacagaagttggatgagtttggagggctcagaagaagacagatgagggaaaatttggaatgtcttagagactggttaaatgattgttaccaaagtgctgatactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgtgcagaacgtgcaggttttttacatatttatacatgtatatttaaaaggaaagcagaccataaaggttttcaaaatttgcaacatggatatgtggtagaaaataaaagcccattttcaggagaactcaagaaggcttctgagcaaccacttgctagaaaaatttgtatacctacaaagaaggcaagtgctgatagccaagacaatggggaaaaaggcctggaaggcatttcagagatctaaaaggcagcccctcccattatagatccggaggcctaagaggacagaatggtttcctgggccaggcccagggtcccagctgccctgttcaacctcgtacactgtgcccccgccccaacccctcccccccgcacccagcgtcctggccactgtagctccagctgtggctcagagtggcccaagtacagcttgggccacagctccagcgggtacaagccataagcctgcaggtgcacagagtgcaagagttgaggcttgggaacatccatctagattttagaggttgtatggaaaagcctgggtttccaggcagaagcctgctccaggggcagaaccctcacagagaacttctcctggggcaatgcagagggaaaatgtgggctttgatcccccacacgtagtccccactggggcattgcctagtggacctgtaagaagagggccactgtcctccagactccagaatggtagatccactgacagcttgacccttgtatctggaaatgaaacacacactcagcaccagaccataagagcagctttggaagctgaaccctagaaagccacaaagttggagtctgcccaaggccttgggagcacaccactcccaccagtttaccctggatgtaggacatggagtcaaagcagataattttggagttttaagatttaatgactaccctgctgggtttcagacttgcatgagacctttcttttgaccaatttcacccttttggaataggagtgttgactcaatgcttataatcccattgtatcttggaagtaactaattggtttttgattttacgggctcataggtagaagaaacttaccttgtctcagatgagactccggacttttgagttaattctggaataagtaaagaccttgggggactgtttggaagacatgattgtatgtttaaatgtgagaaggacttgagatttgggaggggccaggatggaatagtatggtttggatgtatgttcttgcccagatctcacattgaattacaatcctcactgtcagaggtggggcctgggtgggagccgaatgaatcatggcgttgaatttctcatgaatggtttagcactatcctcttagtgctgttttcatgatagtgggtgaattcttgtcagatccagttggttaaaagtgtgtggtaccctcccactcacctcttccctggccgtgtgacatgactgctcctccttcgcaatttgccatgattgtaaatctcctgaggcctccgcagaagcagagcagatgccagcatcatgtctcagggacaacctgcagaaccatgagccatttaagcctcttttcttcataaattacccagtatcagatatttctttatagcattgtgagaatggcctaatacatgaccccaggccctggcttacatataggatcttgcaaacccaccagggaaaaattgctaccctgaagtgaaaaacacaagcttcattggatttgccacctgccgattgtagagtccttgggccctgagtgaatgtaggtgatagccagtcagtggtcagtgtgggccttgatcaagacccagtgttgtactggctttaggagtgacccaacacaatcctagtcgtggtagctacaggggtgcttgtgtcacctctcctttagctccaggcagctcatcacagagagagactctctttgttgaggggaaggaaagagaaaaagattatctaccaggtaatacaggggattttcctgaatcttcccaaagatcaccaaggcagtacgtttaacagtctgcaagagtcacagcattactgggcttgggtgcaccccagtgcatatatggctgcagtgaccaaaggaataaatcacaacacccaagaacctttaaatacctggaaagccctcctgagaagtatggatacaaacaagccgatactgcaaagactacaataaataccaaagtcttcaatgcccagacattgatgaacatccggaagcatcaagaccatccaagaaaacatgatctcaccaactgaactaaataaggcatcgctgaccaatcttggagagacagatatgtgacctttcagacagagaattccaaatggctgatttgaggatgctcaataaaatccaagatagtacagagaaggaattcagaatcctacacataaatttaacaaagggattgaaataaaaagaatcgaacaaaaattctggagttgaaagatttaactgacatactgaagaatgcgtcagagacgagtaacagaagaattgatcaagcaggagaaagaattagcttgaagacaagctatttgtaaatacagtcagaggagacaaaaaagtcctaaaaagtttattgaagagggtaataacacagaacttcccccacctagagagagagattaaaattcaagtacaagaagataatagaacaccaaggagatataatataaataagactacctcagggcatttaaaaatcaaacttccaaaggtcaaggataaagaaaagatcttaaaagcggtaatcatataaaaaaaaaaatcacatagaaatagctccagtatgtctggcagcacaattttcagtggaaaacttccaggccaggagagtggcatgatacatttaaagtgctgaaggaaaagacttttattctagaatagtatatctatgaaaatcctcttcatacttgaaggagaaatgaagactttctaagacaaagaaaagctgacagatttcattaacaccaaaccttttctacaagaaatggtaaagggcgttcttcaatcttaaagaaaaggatgttaatgagcaatgagtcatcatctgaagtaacaaaactcactggtgatagtaaggtttgttactattctgttacaaagagaatattataacactgtgattatgatgtctcaactacccatatcttgagtaaaaagactaaaagacgaacctatcaaaaataactgcaacaacttttcaagacatagacactataataagatataaatagaaacaacaaaaagagtggggggatgaagttaaagtgtagcattttttttttttttagttttctctttgcttatttgtttatgcaaccagtgttgtcatgaatttcaaataatggattataacttattctttacaaacctcatagttaccacaaatcaaataatgtactcaggtacataaaaattaataagaatgtataacatatgaccagagaaaattactttcattaatagtaagacaggaaggaaagagagaatgaagagaaggccacaaaacaaccagaaaggaaatagcaaaatgggaagtgtttaagtccttaacgtaccaatgataacatggaatgtaaattgactaaactatccaatctaaatacattgagtgacagaatggataaaagaatatacaagacacaataatctgttacttacaagaaacacacttgaccaataaagataaagatagactgaaaataaagggatggaacaagtattccatgccaatcgaaaccaaaaaagaacaggattagctattcttttatcagacaaaataggtttcaagacaaaaactataaaaagggacaacgccggtcattgtagaatgataaaggggtcaattcagcaagaggacataacaattgtaaataaatatgtacccaacattggaacacccagacgtataaatcaaatattattagagttagagagatagaccccaaaacagtaatagccggtgatttcaattccccattttcagcagtggccagatagatcatccagacataaaatcaacaaagaaacatcagacttattatgcagtgtagaccaatttgaactaatagatatttacagaacattttatccaacagctgcagagtacatattcttcttctcagcacatggataattttcaaggacaagccatatgttctgccacgaaacaagtcttagaaaattcaaaaatcaaaataacataaattagcttttctgatcacaactgaatatatcaagatatcagtaggaagaattttggaaactatagagacacatggaaattaaacaatatgctcttgaattatcagtgggtcaaagaagaagttaagaaggaaactatagaatttcttgaaacgaatgaaaaaggaaacgcaatgtaaccaaaacctatgggaagcagtgaaagcagtactatgaggaaagtttataggtataaatacctacatcaaaaaagcagaagaactttcaaataattgaatgatacaccttaaagagctagaaaagaaggagcaaaccaaacccaaaattagtatgagaaaataaatattacagtaaggaacagagctgaaatacattaaagtacaacaaaatgatacaaaagatcaacaaaacaaaaagaaggtttttttgaaagggttgacaaaaatgacaagtcttaagcttgactaagaaagaatgagatccagtcacttacaacaacatggatggaactggaggacgttatgttgattaaaataagcccggcacagaaaaacaaactttgcatgttctcacttacttgtgagagcttaaaaaaaaaaaaaaaaaaaaaaaaaaaaaaaaaaaaattaaaacaactgaactcatggagatagagactagaatgatggttaccagaggatgggaatgctagtgggtcgggggcagtggggatcattaatgggtacaaaaatatagttagattgaatgaatgtgatgtagtatttgatagcacgacaggatgattactgtcaaacataatttgttgtacgttttaaaataacaaaaagtataattggaatgtttgtcacataaagaaatgataagtgctcgaggtgatggataccctattaaccctaatgtcatattatgcctgtatgcctgtatgaatatgtctcttgtatcccataaatataaacacatactatatacccaaaaaaataaaaatttaaaaaatagggtattgtggtttctatcattaaagtaaacatcatgctaagaacaattgtctcaagagtaacaactgtaattttcgttttggtgaaaataataaaattattaatgacaatctctgtataaaattccaccaaatgaacttctgttttctatttttttaatatttataatcagtgccataaatgactttataatagatataaagttaatctctaaaaagttaattttagttcaggcaatattgcatgattgtgaagcaggccccggagccaaactacctgagttcccactttgtcaccttcccttgtttgcgttttgacccaagtaagcctttgtttccccacctgtaaattggggctaatatcagttgctgaatcaataggattaattacaataatacctctttttttctgacacacaattattattttgtatttaaaaattatatttaaaagccccaaattctacaagatcaaaattactctttagtaagtcttcttttttatttgtaatttctgggggtacataatagatattttagtacttgtggaagtcatttataaataagtaaacgcatgtttgtgcatcctgatcctttgtctccatgttacctctgtgcatctggttcatgttaaccctaacaagtcatgttgtctggatacagctttccaggtatttgccacttgtgaggacccaagggctaaagtaaaaattatggctgtgtcctggggcgggggggggggcggggaagaggcacaatcgttctcaaccctggatgttcattcgaattacctggttggatagttttttacagaaccaatacctgggctccattcccagatattctgattgaattgttggggaatggggctgggacgtcattttgaaaagttctctcagtgattctaatcaattagtacctttttatattaaggcattatttatataaattccactaattcacctatctgtgatagtttgaataaaagccggacttaaacattacctcaattaataactttctgttttttaacctatcttggatttcttttcttttttctctccctcttttattattattattatactttaatttctaggatgcatgtgcacaactcgcaggtttgatacataggtatacatgtgccatgttggtttgctgcacccatcagctcatttacattaggtatttctcctaatgctattccttccccagcccccaatacctttcttaatagagaatgaaacaaaagctgaaacaaagttgattttaaaaattacttatttaagcagatgacagcattctagaagcatctagttgcatataaagaattgttaagctaaaaccaaaactaatctatctataagaaccaccttgctagaatttttgagccatcgttttgttatttttatctatttttttaagacggagttttgttctttcacccaggctggagtgaagtggtgtgatctcagctcactgcaacctctgtccccccgggttcaagtgattctcctgcctcagcctcctgagtagccgggattaaaaagtgcttgccaccacgcccagctaatttttgtatttttagtagagatggggtttctattggccaggctggtcttgaactcctgacctcaggtgatccagccacctcggcctcccaaaatgctgggattacaggcctgagccactgtgcccagcctgagccatcattttgaataagtaaataaatcaattccaattttcatcagtacaattttagtttctaaatggcgtgcatttaaaagtaaaaacatgcattaaaaattaagtttctctaatttgtactggtatctttcccttaaatcatattatacaggttttatttctgacttaaatcatgtaattgtattttacatgtaagacatgtcaattgaacatcactggtagttcttttctaatctagactttcattataatacattacctccttttattaggtgtatttttttaaattgaggattgcatatatgccagtaactgtgaattctagggaattgggcctgagagcctgtcttcctaaagagctcacacctcttggtaatttgtaagttttaattgtagtcctctaggttttataaagtctatccatttatgcctttattagttagtgcctagcatatgattatgttttcataatatatgtttatacattttataatgtatttccataaagcacaaaaaatgctattaggaccatcaaatacaggctgaaattaatgaaaacatgtactattttgcatttataaatttgtatatggaaaatgaaaattttaaaaaatgctattaatgtttattgctagattgctaaacttaggatgtcattcctcatagacattggaggacaaaataaattggtatggataagtacttgcaaataaggattcacggatattggtaatctaattatctgtcggtttatagctgtgctgtccaatattgcagccgctagctatgtgtaggtaaattataattattataattaaatatagttaaaaattcagtttctgagccttactagccatacatatttcaagtgttcattattcccacctgactagtgtccattatatatgtatacctatagtgcacacatagaatatttacatcattttagtaagttctggacaacactggttaaagaataattgccttcctacattctttcttttttgttttttgaaacggcgtttcactctgtcactcaggctggagtctaatggtgcgaactcagctcactgcaacctccgcctcccgggttcaagcaattgtcctgcctcagcctcctgagtagctgggactacaggcatgtgccaccactcccggctaatttttgtatttttagtggagatggggtttcaccatgttggccaggatgctttcgaactcctgaccttgtgatccgccgcctcagcctcccaaagtgatgagattacaggcgtgagccatcgcacccagccgccttcctacattctaacagagtttctgtaaagcaaagctggcattcccattgaattcctttatgttcatacagatacgttttcatgtccgggggtgggatgacagctctcgagtaaaatcatttgaaaaatactacgtcttagaatgccatttactgcaaatgacaaaaaggccaactcaaagtgacttataccattgctccttaaaatgtgattaatggatccgaagcattgatatcccttgggcagttgttagaaatgcagaatctcaggccccaacccaggcctactgacttagaatgcatagtttgacactctccaggtgattcatatgtacattaaagtttgagaaacactgggcacaatcataaggatgtctgttatctaacaatatatcaaaaatgtcgttgacgctagagaccattaggtctgtaactctatgttgccaaagttccaagttcttacaacttatctgttttgctagcccctctctattctcagatgatctgaacgattggaagtttaccgtagcagttcctagtatcatgtcctgatatgcttttgcctatacctactgtcaggaccaactcctgccctatactactttattctaattccactccctcggctctctattgccagtcatatatgtatactccattcaccttttgcttttactttcccgtctaaatgacgacttgaaggatataaaatgaaacctggaaaaatgcaaacattttttcctatctgtgcatggtagatttttattttgtgactttgacaatttttccaaatttatttacatctttagaatgttagctggaaataagaaactcctgtctcattttcatcatgttttaaattgaactatatgaagccattttcatcaacaaagaaattgaaatatcagaaatttcatatgatctaatacaatattttgcccatgaaaaaaataaaatagtgcacagtcttgggtcacacagggtttgtgatttctatactggcttcacatgccactgtgccagctctttaacctaccactatcctcagaaataaaataacagtagctaggtgcggtggctcacgcctgtaatcccagaactttgggaggtcgaggcaggaggatagctggagaccaggagttcaagactagcctgggcaacatagggagaccacatctatacaaaaagagttaaaaatttgccagggaaggtggtgcacctgtagtctcagctactcaggaggctgaggcaggaggatcatttgggcctgggaggtcaaggcttcagtgagttatgattgtgtcactgtactcgagcctgggtaacagaatgagaccctgtctcaaaaaaaaaaaaaaaaatactagtattataaatctttaccttggcaaggttatgttaaaaaaagttgaataaatgttagccagtgtattttacaactaatattaatgacattttaacccagaggttaacctccccactccctgaagtcacccctttatttaaaccatctttgggaaaaaggacatttgtgtcatgaaggctgttaaactcaccttctgatatcagtgcctccttcaattttgcttcttcctctggttcagccttgcaatggaccactactcacttccttgctaatcacccagaaaactctggcctataattcacctgcactttactgatgctcttttcacaggcctcagtgaaggaaggaagcgtcctcttcattactagttatttcaatctttagagtttttcacatatcagtactgtaataaagcccttccttactttactgaagggcatacttgggcattctgagtctgataccctttgatacttccctgccagtgtcacataaatctatatcttctgagttttagcagtagtaactaatagatcgaacacataccttaagtagactagcagtggttttcaaataaataatattcttacctggaatgttgtcattcaaagtgtgatccatgacccagcaacattggtttcacctggaagctggttagaactgaattcttcgacccaaccccgtgaatttaaatcagaatcaccaggtgggctgtatccatatttaagtttgagaagctgtgatcaagaccccggggggcaccaaatccaaatgcctattgtagaagccagaaacataacataaggaagtgagatgagttgcgtataaaaaaggatagggagtgatgaggactacagcaaactggagagcttatactttgtatatgaagtataattggatgcgaagtataattggatgtgaagtataattgatactcaattttgtcctataggaaggaaggtttagggttgctgaatcctattaaatatgatcaagagtggtcagatttgatatttgtagctaatatctcaaattttaactactggcaaaaatttcaatttattttcaattagtatgagaccaaatccagcatatggactactatttgctaatatctagtcaaggcctgtagtaaggaaaagaaatattttctcaattaaaacatctcagaatcctttccaacaatgggatgaatgctttttgttttcgtgcttattagtatcacacctccacaatccttaggttcttctgttttcaaacttgttctgaggttaatttcatgcttcagacacatgaaatcctgctttttggagcctcaggtagaacccattctttggcagttggcagtcacacttctctctgtaagtggaggtgaagtcaggaagagaatgtaaaagtctcatgtcaaaataattcatagtaatctcctggggattggcagttgtcctcctattaatgttaatatcttggtctctgcagaatttgggtgagttgtgtttgtagaataaagttacctagagcagtaattttcaagtgtgagtatgcatcagtcacctggaagtcctgttaaaatacacatttctagacctcatcccagagtttctgattcagtaagtgtgagtcttgcacacacttctagcaagttttgaatttgcacttctagcaagtttctaggggatgggctgatgctgttggtccagggtccagtaaccacactttcagaaccactaatgaagagagaaaaagcagggctctatttggctgggagacattgatgtgactgtaccagtcattaaaatattgagccatcccgtttgcacacacccagccattctggtccctaccccaaaaatccccaaccagatgtttctgtatcccacttataaagagaaaacacctggctgggttcggggactcgcgcctataatcccagcacttttgggaggccaaggggagaggattgcttgagctaaggagttgaagaccagcctgggcaacataatgagaccttgtctctattaagagaaaaaaaaaaaaagaagataaaacacttatgtgtacatctcttcttattggtcaatctctgagtccaagtttgtaaaatgaaaccacgatagaacatgaaagattactgggtgttcaaatttcagatttggggcagagctcaagaaatctctgtggacccacagattaaggtaggctatgatactgtacaaccatcctgcaccttgtgcgatcaagctgcactggatttccggttcctctgtgatgtgacagggcctttcacaggtctttctttccgtctagaaagagtttataccttctttttcactacttctgacttcagtcttcacagttgtccagtactgcactaaaggcccccctttacagactcaattcaattgctctcatttcatagtatgatcacattataaccaactaatggcctgttgagctatatgtattatctgtggccctcacccgccatccatataaactccaagatagcaaggggctgtgttggtcttccttgcctctccatccgtagtatccaggtactcaataattgtatatttcgtaaattaatgaatgaatttttcaagtctcaactcttaggctgtgtgttctgcgaggacactgttcccaatgactgcaggtcaatttgtatcctctccttactccctcaggaatgtatataaatctaattataatggatttcttatattctaattatttttgtatttatgtctctaatagtctctaagctacttgaaattgaagataggtattttgtccattcctaacaaatatgagtttcctgcatagatatgaaactcagtaaagatttgttgaaggaaatgtctgtccaaaagcaaaaagtaaatgatgctttcaaatactagcaactttcagtttttgcttccacttaaatggatatctcatctctgttgtttctcataaaaataaaatgtctactttttgtgtttgataaatgaaagtttattctcataacttctgattgcaatgttcctcatggtaaatgtgtctctaaaatgttaaaagtcaataaatagtgcaatctaaattattgtaaacactctcaaaaggaatatgaaatgcatattggaagaaagctctgataacaaccccaatacttcggaccagctatggagccattatcttttatattttattttactggtttacttcccctgtttccctgtaattttatatgaagagtgtgagtggtatgtaacattacatacaggttccatgttggggtttaaatagcctggcattagtgtatgaggataaagatgctgatggaattttgtatccttttgttttaaatacacttatactaatttaagtattttgatagttactctgtttagcagattcatttcacttttctccttcttgctctgttcaaagaggatgaagtctagattttctgttacccaggttcctcttggcctttggttgctaaagtacttcagccaatgggaggcactggcaagagggtgaaagcagagattgtggtacttttctcttcctcttctgtttcttactgtggagtggctggaattgtgttcctcttaaactacagctactgttggacagctcttgttccatgtctctaattctcactgagctccggcaacagctctcttccttttttcttccagttccggggatgctaggtcagttgtctttgttgttaggtcctggctccttcactatcgtttattatttttcccccgacccttcacataaatgtgtaagtagtctactgagcgaaacatatttgagtgtgttctatctttcctgccaatagtatgcagcatccacacacacactcaacagacccaacttttatattttattgtttgaaatgctatcaatttctaaacattgctttttaaaccctactttaaattgacagataaaattgtatattcatcatgtacaacgtgatgcttctgagtaaatatatattgtggaacagttgaatctagctaattaacatatgcattaccttacatatttatcatttttatggtgggaatatttaacgtcctctctctctacatttttcaagagtatattttcattagctgtagtcaccatgctgtaaaatacatcacttgaatattttgactgtgactatatatcccttgaaaagtatctccatacctcccccttccccataaccacctcagcctctggtaaccactattcattccctacttctgtgggatcagctcttttagattccacatataagtgaaattaggcagtggttttctttctttactggcttatttcacttaacataatatcctccaggttcatccatgttgttgcaaatgacagtattttattcttttttatggctgaatagtattccattgtatatatgtataccacattttctttatccgttcatatgttggtggatatttggattgattccatatcttggccatgaatagtgctgcaataaaaatggtagtgcagatatttctttgacatactgatttcatttcctttgtatatataattcatagtgggattttgtatcatattgtagttttgttgttcatatttcaaggagccttcatactgttttccatgatgcctgtactgattgccattcccatttacagtgtgtaaaggttttcttttttttaattagtaatttttaacttttgcaggtacgtaatacatgcctttttcctaaatcgttatcaacatttatctttttttgttttggatagtagccatgctaacaaaagtgaggtgataatctcttcttttttcttttgacaaagatatcgttaattactattatattttaacttttaggtgcaagggtacatgtgcagttttgttacatgggtaaacttgtgtcatggaagtttattgtacagattatttcatcaccaggtataagcttagtactcattagttattttttcctaattctttccttctgccaccctccaaactccaataggccccatgtctgttgtttccctctatgtgcccatgtgttctcatcatttagctcccacttataagtgagaacgtggtgtatttggttttctgtttctgcgttattttgctaaggataatggcctccagcttcatctacgtttctgcaaagaacataatcttactctttttcatggccgcatagtattccatggtatgtgtttaccacattttctttatccagtttaccactgataagcatttaggttgattgtctttgtgattgtgaatagtgctgccacgaacatatgtgtgcatgtgtctttttggtagaatgatttatattcctttaagtgtatacacaataataggattgctgggtccaatggtagttctgttttgaggtctttgtggaatcaccacactgttttcaacaatagttgaaataatttacactcccacaaacagtgtataagtgttcccttttctttgcaagtaagctgatacctcattgtggttttaatttgcatttcccagatgattagtgctgttgagcattttttcatatctgtgttatccatttgtcccttttatgataaatgtctattttggtcttttgcctatttttaatcaggttatttgttttcttgctatggagttggttgaatttcttccatatttttatatgaacccccatcagatatatagtttgcaaatatttttctcattctattggatatctctttactctgttaatttttaattttaattttaatttttttgctgtgcagaaatttttagtttggtataagtcctcagtctatttttgcttttgttgcttgtgcttttacagtcatattcaaaagttattgcccaaataattgtgatgaagcttgtcctctatgttttctactaatagattgagagttttgagtcttaaatttaagtttttaatccatttcaaattggtttttgtatgtggcaagggataagggtctaatttcattcttctgcatgtagattcttacttttcctggtagcatttgctgaagagggtgtcctgtcctcacggtgtgttcttgacacccatgtccaaaatcagttgaatgcaaatgcattaatttattcctgggttctctattatgttccactgatcagtttttatgctaatacaatgctgtcttggttactatggcagaatttcttctagttgcgtactttgaccttagtgggaaataaaaaacatccttccaaagaaccatattattagtgtttccatattgatcgagtatcttctgttttttttattggttaacactatcatatatgggtatactaagagactcctggcaaatgcccatagttttctaatgtagtactacttgccccgcattgtattgggtgaactcagttgaccatttgtgcttaggttctgtatggtaacccctttctctgtctgtggattcagcagcatgaggagccaaacatgaacagcggtcatctcaacttctagtttaaagaaatcatttttgagtttcttataactcaaaatgttgaagaggtagttcaaaaaaaagttgaagaggtagttcacagataaggaacagaagtcacaaggtggagagagatggataaattaatattaggttaatacagatgagataattatatatagaagtatttatgggtgagtacacactcacacatccacttctttatgtcaacccagaggtcctgtaagctacaacaccctagaagcaaggagcatacctagcaacaggatcttgggtttcagtaacattctttaaagaaaaaaaaaaaaaaaaaaaaaaaaaggaaccagaacactgtggagaaacagctgattctaacactaggaaagggaatatagaaaatgagcctggaacatttggtagtgccagatagtaagaacatgctaaactccacggtctcgctctaaacaaaaaacactgatgggatgtgtcaaagaagccaactaagagacttcccaatgtccaaagctggaactatttgagcaaaaatccaaagcaaaaactagtattggatttagcccaaagtatcaaataactatacatgagtccatgctatgtaaataaataatttcataaataaatggaggaatagagacaaatctccaatgcagaaaaaactccaaaaacttatgtaacttctctgccctcacggagagggaatgtaactccccactccacaggggctgtgtatagtgactttcttattaaaaaacagtgtgaaaagagggggaaagagtaactttatagtggataaacatgacacctattactttagccaggtggtcacatttaacattgataagtcacgttgagggtatatatgctttataaaatgtgcttaaaatggcccattacttctgtggtctttcaaaaaccccagtttaattatgaggaaaaaaaatcagacaaatccccactgagaggcatactacaaaataccagcctggccagcacttttaaaaactgccagaaaaattctgagaaactgtcatagccaaaagcagattaaggaaacaggacaattgagtgtaatatggaatccttggagagatactgaaatacaaaaaatagtttaaggaaatcagaatataataatagtctccagctaatgcacaaatattggttcattaattgtaagagatgttccataataacataagatgttaataaaacgggagactgagtgcaagttatatgataactctttgtattataatctcattaatttttcgtgaatctaaaacagccaaaaaattaaatctgttaaaaaacactctcagctatgtgtgcactttgtgtgtttaaatgtgatgattaatggaaacttccagtaaagattttagagtaaaattatgtattcaaaataacatattcctaattcaaattataagatcaatgttcagaatatagttttgaaaaatgctttaaacatgatgtttataaagagtatttcctttaaaataaccatcagcacttctcatttgcatctcaaattttggttgaattaatgaatgaacaataatgtgttttcatcctcaacataaagttgtgtaattaataggcaaaacattatcccatgtccctgatgctggaaatgtaattgagaacgtttaagaacctggttgtagagcttaccgctgggctgtgaacctaggcctttggactttaaattcattacccagcccactattttctatatctttgtggggaaaaagcaccctttctctagtctatttgtgtgtatcaaatgacgtccaaacttaatgggttaaaacaatttataattgcgtcatgatctgaagaccgagaatataagcagggctcagccaggttgtttttatattactagttttatagctgggggtcaccccttgggctgtgctgagctggaagctcacttctaatacagtattttatcctgcagaatcactcctatatggtctctaatgattcggtagtgtagcctggcctcctttacagcatggaatctaggcttcaagagaggaagaaatacaaatgctgccagttcttttatagcctacacttggaattggtgtggtgtcagttatgccacattctgtggtcaaaaaaaaaaacacaagtccagatcatattcacagggatggaaaatagacctcatctcttgaagggaaaagtgacaaagaatttgtggccatctttaaccaccacacatactaaataatgagaatgtaaacgaacaactgccaaaatatactacttagtcaattatcagatgctttgcacttcagttagcatgttcacatttagttgactatgtgaaagtttttagaaatcaggatttgtgaactattataagtctgagaaataatagttccggggtgactgatagtgggctttacttacatccttctcaatgtccaatagatgcccccaaatgcgaacattccatatattataaattctattgttttacattgtgatgttcagtaataagttgctttcaaagaggtcataataggcttctttcaaattttcagtttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtaggtgtatcttatgttgcgtgctttctactagaaagcaaactctgtgtatagtacctatacacagtaacacagatgacatggttgatgggagagaattaaaacttaaagtcagccatattttaaaaattatttttacctaattgtttttgcaatctttgttgcaatggcttgaataagtcccctccaaaattcaggtgattgtattaggagatggaatatttaagggtgaataatccatcagggctcctcccttaagaataggatcaagtcccatataaaagaggcttcacacagtgttctcctatctcttgaccctccaccatgcaccaccatgtgaaaactctgtgaaaaggccctcaccagatgctaacatcttgatcttggatttcccaaactcgagaactgtgaaaaaataaaggtacattcttcctaaattacctcattctcagttatttttgttacagcagcacaaaatggattaagacatttgttgttgtttttttaaaaaatacagcatagctaggcttttcgtatttggaaaagaaatcaaacatatttgtggatgagaacaacgcagggtatgtgatttattaaaaatttgctttcctggaagacagacttcatagggattacttgtaatgcaaatttaaataataaggctacgattttttttaatgtaattttacattcaatttatagtaaattgaagctggccaagcttgatgataaatgagagtctgaagcattgcttttctatagaatatgacattttttaaatgttaatatttccatcttttttcttcagtttacttgtacatttccagttatgctccctcgctgccagaaagcatttttttttgtttctgttattgagacttctacaataatatttcttatccaaaattatgagggtgctttattttaataagtgccataaaatattacaattagctctgagttttattgttgaaataggctcctgctcaattcatgaggaaacacacacacacacaagatcctttgtaattgtcccaggattagggttgccacatttagcagacacaaataaaagaagcctacttaaatgtaaatttcagataaacaacaaataattttcttagtgtgtgtcccaaattgttcattgtttatctgaaattcacattttgctgagtgtcttttattttatctggcaactctacttatgatctgtggtttttggatttatggctttgaataggaatatctgctcctttacctcataccttcgaaatctgccttttgtcaaacttaattctctctttttataatattcagtcatatatagctttacagttcttccatgcaaatgaaagatacatttatttctaagttctagagttttttttaagtttaatgagcttcagttttgaatgacaaatggggccagcccttactattattgacccccaggagtcctctaagatctagcatttaagaagaactgtaactatggtaatccccgtctgctatgccatcaggaaaaaaacatcaactgtattgcaattatgtagaaattgtaactgtgattacttgtcatatagatactaattgagcacctgaagaagaagttaggtacagtgctagttctctaaccgtaccgcttttccgatgtggcacatttgcttctctcgttgacactatatctgccctctttcccttggcctacactggaagttacatgcagaaagtgtctatataaaccaggggtgtccaacccgttggcttccctgggcgacattggaagaattgtcttgggccacacataaaatatactaacactaatgatagctggtgaactaaaagaaataattgaaaaaatattttaagaaagtttacaaatttgtgttgggccacattgaaagccatcctgggtcatggattggacaaggttgatgtacagcaatggcttctctctaccggagggtatttctggtgcagaaccatttcagccagtttgaaggtggacaggaagtggaattagtgccaccagagctgcccttagccaatgaggagtaaaagttgatagagaaatcctgtagaatctttgtcccatagtgggacatttctaaggtatattctccacagtctttcagagattccccagtaagactgagctccaggtatccacagggtaacttcctgaacgtccccgtgctctcataatgccttacgagttcaccctccaaataaaccatttatttgttcacaaatcttttgttcaggatgtgtttttggaggaatctaacccaagacaaacttctcccactagaagccagaattcgagctccagttctaccactaactaaattgtcattttccaaacatcacttaatgtcccaggttctctgtatctttactttggaaataaaagagtgagtttgtttctagtgttccttccagtcacagtttaaatgtgtccaatacttttggaagttgaagtattttagaaaaggccaagattaggccacgtaacactgaacatcagaaggcaggacactgctgctggatgcctggagtgtaaagcgaaatccagggagaagagctccaaaagagcagtagaagaagaatgttagcatagctaagtacggataacctagggcagctatgaaggaagttcttagcttgggacgctgaacagactcttcattaaggtgagacaagctatccaggatcttaatattctgccaggtacctgaaatgttttgtagttttttctgaaagatataatgtgaatgaaatggaaaacgtttgacaaatattgtcataaaatttaaatatattattcattacttgaaagtatgccatttctaatgactatgaaattgccttgaagaaaaaatgtgaaacaaaagaaggcaacaggagtatatgcaagttgattatgtaacattttacctccaggcattatttatttatttaaagggcataaagaggccagaaggcattggttttctggctcagagagtaaggccaactcctacttttaactatttgagcactcttttttttgacagatttgacaatattttttgaaatatttgacagattttttttttataaaaattaagggaaagattcatattcaagtcctgaatattgataatgctcttttgtttcttggcaacaattttggcgagaagaaggtgacttaacatcaaacaatttagcaaagagttgactttatttaaacctgaaacatgtacattatattgtcttttaagactaaaaggagcatacatacagaattaaaggaacactgttttgttagtcttgccacacttcataaaacaaaagaaaataaatgttacttctttgggtaactgagttcaaactaaagccttatttatatagtcgttgaatcgctttgcagctttttttcccaagaattgtaaatcattgaaagtaaggaaatttctccttctgacaacaaaatgcatcagtaaccttagagtccccacaaaagcaactcccatctgctgcatcaccaaacttctaacctaatataatatttatttttagctttgtgtagatagacattaaatccttgtgccatcaccattttttcttaaagatgattgcagatgacaaaattaaagaaaagatacagattttattgctgggaattgatttaaattctgctcagatcagaggtcgcctgctctctctctctcaactggagggcaagattaaaatgtttgcaaatcttgcaagtacactgtgaatattacagatatgcttctgtatattctgtgacaggatcctttgctatcttcatttcaacagcattttattatgaggcaggctagaaattcagacactgtgaaatgtcaggaagataagtcacttttactgaacctggcaattaggtaaggtaaagcaattgatcctatatggtggttactattaaatctagccaaactctttactctgggtaaccaagaaaagttcaattggctgcaccatttgggagaaaccactcatccttcatagacattgctgtagggagagaatttagaggtttgctttagctttgaggcacccaagagtgagtctttctggggagtaaacaaatcgaacctctcattcccctgtgaaaaaatatatcacatataattctagctggtcttttttgtcttaaggggtagaatttattagtgatgttgacaaagaatgaaaggatttccctcgaaggagtggcatgatgctattgaggaggaaaagccttgagctttcattaatagtaaagaagtttgccattttggaggcatttttttcaaaaggaaaatatttaacagtgaaatcttttgtctcctggcacagtgagactgcgatgaagtttaaagctgagtttactagctaggttttccattcttttgagagatttagacttttgtgcatagatgcataaccttggtgacagcatcaacaaagactttacaaattacaagaatttgccgatgtgaatatatactctatattctgacttcagtgaaggttatatgtgaaatactgattaatacaaactaagtagcctcttagaaactcagtcacctatccttttcttgaaggttagttaaaggcagacatttgggttgccaagattgtgaaatatcctcatctggtgacctttaaaatgatctagatgttcatgttacagagaaggattaggtataattctgccaaaggatctgacatttcatttcattccattgcattctattccatatcactgaacaaaccctcattatagcacatgggtgctgtgaagaatgcagaaaccaatcatttacgatgtcttgtactatactgaatgctggaggatttaagcctgatcatggagggtgatcatgagtcttatataaaagactcaggcatttgcagtagtagttctatgagtaacaggaaaccattattcatgagaaattaaactagaaatagcagcaatttaggaaaacttatcttaatatttaagaagatattttttgaggataaataaaagagcagagaaacaggaggccggaaaacatgttaagaggatattgctgaaagtatatagagcctgaatgaaagcaatgacaacaaaaattgtaaacaggtacaaagcattctggatatcaaatcaaaaccaataggactagatttaggatatgaacaaaaagctcaaagtaatagattctgggactgggcaattgggacttgagattggtaattaagaaaataggcagtgaaaaagagaaatgcaatagttggaagaaggataagtgattcagttaagtttgacagtgccataggatcaagtggtgcttttagtggttagcaaactcactctcatatttagcaaggttaaaattacatgttgtttgtttctgctatgaagtttcattttatttcctgtcttttgccctcataagtgcttaatgaaagtttaatggttatgatggtaagggggataaacactataatctgaaaaaatactgtattataaccagagagccagatttcttttgtgttttcagagtgcttagtcaataattgatgctcagtaaatgtttttagaacacatgttctgattatattgactagttttattatccaaatcgtctccatcatggctaactttctgacaagggcatgaaagtttgataatttcaattaaaacgttgggcatacagcaaaaaaaaattcataaagctgtagaaaaatacatctgtaaagtggcttacctggtgatgttatctctggtgtcttcaatctctgactttccttttttccttctatctctgttgcattcccatatgcaaatatcttaatagtgctaaaccattgactatgaaattggtttgagtggtagtattattttgacataaatgattggaagtttatgtaaaaaagaacatcacacttttatagtctacgtagtagtatgtgcatgatattcagttacaatttttaaaatcgaattgagaagacatctaatatcccataagaattctattaacaagcatcatattccaagggtatatttgcacagtaatgctatagattattaaaataataataatataaaatccatgcccatattcttattttacaaatcaagtatttctagctatcagattattatttactttattagaaattactgagtattgattcagtaacattacttagaatgtcacagctttgtttgacagtatatcggtatagctacgaaaattatacctgatcaagactctgtcatcttagaggcactaacattagttattatacttcattactcttgtaatacttcctcatgagaagacactgacctctccaatggtgtttaaaggaaaaaaataagtaccctatttctaatttactgagttagtctcatgtaaaatgtctctctctctctgaaccagtactgtaacaatcaatttcagttctttcgtataggtaatacaaaattaataatgtagataaactaattataaaaaacattttaaaatgcattttagggaaaccttacaagaaagctaagacacacatgataacatgaattttaaggcaataattttccttatcaaatgtatgaccgtatcttataacaaaatgcatgtccgtaaatccaatcccgtgttaaaatataaggttgaatatgatactttttctgaagaatatggagaactatcctgtttaatatttctgttatgaacagaatttctagtggatttctaatactagtagatttctactggtacatctggtagtactctcttattcattggaagtaatgatactgtatcctttaacaattaaatttttatctaagtcatatctagtaagactaaaaaagcactaaactatttttacataatggtctacagttttggcacactgaggatatttaataatggaaatataatgtgattaccaagttattagaaataaatagtgatgctcaaaagggctatttccatgaatctcagtgtaagaatgcaaggataatgtgaatacgtcagaaatgaaagaaaataagcatttcctcaccacctaccaaatctaagcactgtacaagctgaagttaatgtattgtctcatttaactctagtaataagcatgtcttagaagaagttttaaaatagattgagggggtgcatgtgcaggtttgttacatggatatatcgtgtagtggtggagtctgggattttagtatatccataatctgaatagcgaacactatactcaataggtaatttttcacccctcacccccctaccagcctataatcttttgtagtttccagtttatattattccactctagatgtccgtgtgtaccctttgtttagtttcttcttataagcgagaacatgttgcatttaggtttctgtttccaagttacttcacttaggataatggcctatagttcctattcatgtaactgcaaaagacaggatttcatactttcttaggctgtgtagtgttctgtggtgtgtgtgtatatatgtgtgtatatatatgtatgtgtgtgtgtatatatatatatatatatatgcgtatatacacacatatatacatgtgcatatcacattttctttatccaatcatttactgatggacgcttaggttgattctttgctattgtaaatagtgctatgataaacatacaactgcaggtagctttttcatgtaacactttttgttgtttttgttgagtatatacccagtactaggattgcaggatccaatagttgtgttttaagttctttgagaaatctccatactgttttacataatgtttatattaacttacattcccaccaagagtgaataaacattttcttttctccacatccttgccaacacctgttgttgtttgacttttttaatgacaggtatccccttaaaaaaatgagatactgtcatttggaacaatgtggatggaactagagatcgttatgttaagtgaaataagccaggcacagaaagacaaacatctcttatgttctgacttatttgtgggatctaaaaattaaaacaattgaagtcatggaaatagagagtagaaggatggttatcagagactgggaagggtggtggaagggaggtggggatggttattgggtacaaaaattacagttagaaagaatgaaaagacataatatttgatcatatcatacagtaactatggtcaataataacttgtacattttacaataactgtgaaagcatataattaggttgcttgtaagacaaaggacaaatgcttaaggtgatagatactaaattctccatgatgtgattatttcactttgcatgcctgtatcaaaacatctcatgtaccccacaaatacacctactctgtacccacaaatttttaaatgacattgaaaaaaacaaataatagccatactgattggtgtgagatcatatctccttgtggttttaatttgcatttctctgatgattagtgatgttgagcattttctcatatgtttgttggccacttgtatatcttcttttaaaaaatgtctgctaatgtcctttgcctactttttaatggggttatctatttttcttcttgttgagttacttttagattctagatattagttttttgttagatgtatagttcggaattgttttccattctataagttgtctgttcattctgttgattgttttttgtttttttgtttgtttgtttttgctgttcagaagattttaaaattaagttccatttgtctacttttgtttttgagtacttagtcataaattctttgcccaagccagtgtcgagaagagtttttcctaggttttcttttaggatttttatattttcaggtcttacatttaagtctttaatacattttgagttaatttttgtatatggtgatttatgacccagtttcattcttctgcttatgactatccaatatttacagcacaatttactgaataggatgtcctttccccagtgtatatatacatttttttactttgttaaagatgtgttggtcatagatatgtggttttatatctgggttcttaatttggttaaatcaatctatatgtatctgtttttataccagtaccatactgttttggttactgtagccttttagtataatttgaagtcaggtaatgtgatgccttcaactttattcttcttgcttagcattgctttgactatttgggctcttttttgattctctatgtattttactatctttttctaattctgtgaaaaatgatgttggtaatttataaggactgtgttcaatctgtaaattgctttgagcagtgtggttattttaacaatattgatgctcccaatccatgagcagggaaagtttttccatttgtttgtgtcatctatgatttatttcatgggtgttttgtagttctccttgtagacacctttcacttttttgtttaaaggcattcctaggtattttttttttttgtagttgttgtaaatgagattgagttcttgatttggttctcagcttgatcattattggtgtatagaaatgctaccaattttgtacattgatttcatatcctgaaactttactgaagtcatttatcaaatatagggtccttttggaggagtcttaagggttttctagatgtaaaatcctatcatcagtgaagagaaatcatttgactttctttttcccaatttggatgccttttatttctttctcttgcctgattgctctagctaggacttccagtactatgttgaattggagcagtgaaaatgggtatccttgtcttgttgtagttcttgggggaggggggtgctctcaacatgttcctgtttagtatgatgttggctcttggtttgtcatatatgacttttgttattttgagatatgttctttcaatgcctagttgttgagggtctttatcttggggagaggctggattttatcaaatgccttttctgcatctattgagatgatcatatgttttttgtttttaattctttttatgtggtgaatcacatatattgctctgcatatattgcaccacacaaaacatatattgtgttatgtggtgaatcacagatattgctctgcatatatccctgcctacctggcataaagctcacgttattgtcatgtattatctttttgttatgcttttgggtttggtttgctagcattctgttgaggatttttgcatctatgttcatcagggatattggcctgtggtttcctttttgttgtgtccttacctgcctttggtatcatggtgatactggcttcgtagaattaattagggagaatttcctcttgtttgatattttgcaacagttacaataggattggtaccagttctttgcatgtctggtagaattcggctgtgaatacgtctggtcctgagctttattttattgggagatatttattactgattcagtttcactatttgttattggtctgtccaagatttttgcttcttgtggttcaattttgggagttgatatgtatccaggaatttattcatttcctccagattttctaatttgtgtacctagagatgcccatagtagtctgataatctttcgtatttctatggtatcagttgtaacgtcacatctatcatctctgactttgcttatttgattcttctgtttttttcttggttaatctagctagtggcctattaattttgtttatcttttcaaagaaaactctctaatttttttaattttttgtcttttattatctcagtttcatttagttctgctctgatcattgttatttcttatattctgctagctttggtttcggtttgttcttggttttctagttcattgaagtacaatattagtttgctaattttagatctttctatctttttggtgtaggcagttaatgctataaatttccatcttaggactgcttttgctgtatcccagaggtggaggtatgttgtatgtctctttttatttgtttcaaaaagttttaatttcttccttgatttcattgtccaaagatcattcaggagcaggttgtttaatttccatgtatttgtatagatttaaggagtcttcttggtactcatttctagtttttttccactgtggtgcaagaagatgcttgatatgattttgatttttttaaaaatgtgttaagaaccaccttgtggcctagcacattttcaatttttgataatgatccacgtgcagatgagaataatgtacattctgtggtggtagaatagaatgttctgtaagtgtctggcctggaaggatattaatacttgattttacagacaaatagatgtgttcaaagagtttaaggagttgttcaaggtaacttcagtattaattggtagattctgattttaactttgacctgtctgcctttgagaccatttctctccattttgagattccagtgaagcttgactccacctgagatcctagagactagagcagttgcagagaagtgacaaagagatttgaagatgttgtggcatttggattcccaggattgggaatgtctagatagaaggtacagagactgtgtgcatatgagtcttcaaacatagagtaagcagtagtggtagctacacattaaatactcagaatcaaaatgcttaatgaaataattcatcaccattactcctgtagttctttaaaatagaggaaaaagagactataagggaaacaggaatataggcttatgataagaatggcaataccgtctgagcaggaggataatcattggaactgaatttcacaactatattctgttagcagcacaatgcatagcatttcctctgtgctctgcctgaaactttccaccccaactctctcccaataatcttcttttctttttcaataattattttcagtaaaggcattttataattatttattcaatgttattggtttttaatctgattttaattctgtaactatatgcagaatgtatgggtgggtgcatgcatggattgtagaaagagtaggaaaggcaagagaattgagggctaccatttcgtgattagggactgtcctcactccatgacatatgtctgcccatgcaaatttttctgtgataaccatcagatgaggtagtttgaacctacttttattaatgtagtgtaaataaattggaagttcaggtattatttaaggatttaacacttactgtatatttctccagaccttaaaactttgctgtaacttcacttgttttcatgacttttcaaaaatcacattctcttcctgcacttatgatgtctattagaaaggatgatagtcagaatgtattagatgagggtaaaatagattagtattaggttaggtcattgcagtttagtttcaaaactttgatataaatatggctaaatatgaattctttcaactaattagatgctaatatttttggaatttatattgttttccaggcaaaatgcaaaacagttttaccttattcaatcttcttaaccacataaagaaataggcagttttattatcttagttttacaaattaggaagctgaggcttggtgtggttgatgactttctcaaagtcacgtgattggttattgatgcttccaggaattacacatagaaaatctgatttcagatgctacacttttgactacagttttactgtctcctcatagtcatgcacaagttttggtcaatctatttcatcctatgtccttttccatatgtaggagtacattaattgtctactttatttttaaaacagtttcttttcgtatttattgagtccccttcaggctattgagaagcatttagtgtgcttgtatagcctttcaaatctctccattgaaacagtctttcagaacccccatttggtagcttaggagttggcagaaacataaacattcatttctaacaaaaagataaaatcagtgtgttctgatataagaactaataaagatattcaatcacatttaagtaagtgaatatcaaaagcttttctagggtagcctgttgaggaagattatttaaaatattcagcaaatttataacaaagttatataccgtaaatagatcttcatggaaagctagacaatactgtgaccagccaggcttagcaaagtgaatatttcactgcaaataaaatcgaaagtcctttccagatcatatcattcaggccagcaagggatatagagcctagcccagtgtagaggtggtagaaggaatggggcatagaggaaaagagtgaaaaaaataaattacctaccaccccatcatttcccaagaaatcctaacactttctgatctgtacttgaagtttttatttgaaaaaaagtcaattcctgtccagatgtcttgaattaacatgatcattagtatctagggatttttttgttcatgagacagcttttttaagatacttctttcctggatgttagactcaactctattcctagaaccttctgaattcttaatgtcctttgcaaattttatgtttgctacaatttttttctcgttagtctttccttatgtgtgcatttattgagataaactacaaactactgaatatttgtaattaaacatctaaatatattaattttaaagtcatttttggagacaatagattgccttccaattcatgatgaacagcgttctgtgttgtttctaggggtgtgttttgtgtgtgtgtgtgtgtgtgtgtgtgcgtgtgcgtgtttgtgtgtgtgtgacctgcaagtaccggcaattagctgttgggtattcaatgaagtcggaggagtagttaaaaaaaaaaaaaactttacatataggtaacagctgttcttttcctgttctttccatagctgagtctatgctatggccaaaagaaatagacaagtaaaacaaaagcttctcccatcgaatttacaggatacccatccttgtttttgttttctattatactgcctttcgattaattattgctcttcacctttaaacatcaaatcaaaaatttccctagccttacataattccatgtctttatttcctaagtattattttacatgtgttctaagaaagggtaaaatagcatagatctagaataaacactgaagtggctctccagtggtttttctaagccacttttgaaaaccaacttgacatggacaagagccagaagaattcagtatcactgatggcatttaaaagaagtacaagaaaagtcaggtttaaataataaaattgggaacatgtactaagggagtaacaaattttgttaagccctttaactagagacttatttagaagaaatacaattattcacagaggtataacaaaaactgtttgtccaatctaggcattcttaatgttacatctcactgttggccttttctcttgtcataaagaaaaaaatacattatttgacatttgacaacaaacattggtaacatttgtatctaataatggtaatgaaatttaactaggaacatgatagatgtttgaaatctggtaagtgttacaaaagcattcctttaataaaataatgaaaataaatgcataataaagtacctagtatgtgtgtatatatgtgtatgtgtatgtacaatctggaagcttttaataaaggaaaacattttaacaatattatattacaatattttaatttgaaggtattattttctgacagacaaacatttttgtgtacttctctagggatgcatctatatttggaaactatttggctcatatttcaggcttaattagcaaatccaatataaatctccgttgtataaattcatctatgacaaattgaaatccataagaagtcagtatttaaaattgtaattaaatatagccttacaacactttagcatattattttttttaaatactcttgagaattcatttctttccaactggagaaacaggcaggcattctttaccccaatgatcaaggcctttattcatggattcctagtttggcagaacaattgaactttttaactccagctttttatgtctggcgtttctgctacttgtaagaatcagtgtaaaagtaaaccctgaacgttgcatagttcataatctgtattttgctgatattaaggagattagctaatacagttatattcactaatatttatttcgcatttgaagtctgagaaaataggagacgtgcttactgttttaccatagcttttgtcttacagctatttagtgtgctcaaaaaagtcagtttaaccttttttagtttaattcctaattagctgagaaagaagaaatacaattttaaaaagtcatagaggagaagagatactggaaataacattaaatcaaatgtaccttatgcaaatctactccagcactctggactcttcaacgttcttagtcactgtagagagcctttccccactcctttatttccttgtactcaccgtaagtccagagggttcttgtgttagattttaatgctatcatctcacaactctctttagtggtactttacgttagcacttctgccaagcataaaatataaacccttgatcaatatggcaagaatgccatttccaattataaaacaaatagatgaacgaaacaaaatcagaacaactaagtaatggagaatatagtacgtttgatcacatagactttaaaagactcaataagagttggattcattccatggatccaatgtttttcttacacttcttaagtaaaatatattaaaattgtgaaaaagcaatttacatgtaaaaatgaaaactggcattatttacttgtaattttgtaatatatgtaattatatatactcattgaaggacagaaaagaattgactaaattcagaaaaccaacttatgatacactggccaccaaattatcattttaattattatttgaaacattcccggctgacaccttcaaaatgttcccagtcctgtcttatataactcagaaaacacagactcaacatgactgtcaaggacaactctgaattttaatgtttccatttttggcctcatggcaaaaagagttttattaaccattataagctctggaatgtcaaaggcatgataggcagtatagattgcacacacaaaatagatgcatagtcattttattctaaattgcttcacttgaaaatgtagtatgaaaatctagagagacgaagtaaaaagaagtgattttatagtgttctaaaatgttgaggcttcgaaaataagaagcctaggataaaaatgctcatgcatttgagattgtgattcagccatcctaataagttcccttccacctgccatagagtttgaatacctaagagctagactgataggtgctaagcactgttgttttgcaagtagggacagcacgtttgccagaaagtaacgggaaatgtcccaaacttgtttctccactcttgtgttatgtaacaaaatgttctaagaaacaaagtagttgcctagaagtctcaaatagctattcagagaaatcccaataataaatagtgtaacagggtaaggtcttatgggatctggagcacccaggcaacataccttggttctagagcagcctcctttgtttacccctaatttattcctgtgtttacccctgttcatcattacaaaataattgtacatcatgtttttaaaaagattggaaatactgttttgtgacagcctcacttaatagggggaaatgattttttcagagccacatttgtaagttagaaaggcagtatttgaattattctggttttatcctagggttcagttgagaccaagtggttattttctgttgaggttagtgtaattgtgattacaccaaaaatcactaattcttcctattatattgtaatctttgtgcaatcaggaaggaacaaactcatctgtgcatgttttccccaaacccccacatggtaccatttatctgacaaatgtttattgatctttatttgcttgtaatacatagtgagaaggacagagggcatctctgttctagtggactgcctattatagtaagtagagacaaaaggactaagctgatacataagaaattattgagtagtgacaatactatgattaaaaaaatgacagaaatggtgaattactagggagcaacattggatagtttgctcatgaaaagctgctctaggtaggtgacacttacattgagtcctgaatgataaagaaatgatttaaacatctggaagaaaagcaatcctggtagagggaacagcttgacacatttttggaagagagacaaagcaagtcattctgaaacactgtgagggcgagaatggtatacaattagactggtgaggtagtcaggtgctagatcatataagaatttcaggtagagaagttaaattttctttcttagtatgatagaaatctattggtttttataaatcggactgacatctgatttgtagtttgagcggaagggaaaaaacgagtaaaggagctaaaaagtagtgtataggccaggcacagtggctcacgtttgtaatctcagcactttgggaggctgaggtgggtagattacctgaggtcaggagtttgagagcagcctggccaacgtggtgaaatcccgtctcaactgaaaatacaaaaaattagctgggcgtggtggtgtgcacctgtaatctcagctactcgggaggctgaggcaggagaatcccttgaacccggtaggtggagtttgcagtgagccgagatcatgccattggcattccaccctgggtgacacagtgagaatccgtctccaaaatagaaaaaaaaaataaaaaaagtagcacataggtaggagggtaatcaagagaaggtgtcaagaatgagggagtggccaattaggttagtaatcaacatgtcaagtaagacgctataacaaatggttattgaatttaggaacatgaaagttgatggtgtcctttacaaaagatatttcaatgggttagtgggcaaagtgaatagtaggataaatatgtaggcacagtaactataggatacatttgtttttttttttttcagtgaagaggaacacataataggacagtaggaggaccggtttgttggatcaagagtttgttttatttttatggtaatggagaagttcagtagagaagaagagcctgaaaatgccagaagtgctgatagttgtaggaaaaaagtccttgaaagggagaaagggggtgggatgagaaggagaacatcctgctgtacctttcttaacatttgtcttctctagatactttccagttaaattaacaatagaacatataaattttgctgagcgtcatagcagaaaattggcttggaatggttttaggttaataaaaaatgggagtacctgagatgtagcagaaataaatttcaccatttgagagcaaatcatttcaacacacatgtaagaatatcattttaatttcctttaaaacattttatctttcaggtgcttcaagaagatctagaacaagaacaagtcagggtcaattctctcactcacatggtggtggtagttgatgaatctagtggagatcacgcaactgctgctttggaagaacaacttaaggtcagattattttgcttagtaaactaaatatgtcctttaaaagaactataacttgaaaagtattttaaaaatttagaatgcaatttatatattaaaatacttagaatacaatatgtgtacaatatacacacactcataatcagctgaagtgctgtgatttaaagaattccataattctgatacaatagtaactaactgcggatgggtaaaatctaatactttaccagaaaatttcaattaatattaaataaggctgggaagcaggggttgaagggaggttactggttaaaaaaaatttaaatgcagacatttttctaaggcatggagtatttccatttaaaataacaattgaaagcacccatttcatcattagctgacccagtgtgaatagcttttcaatataattcatccaaggtgatgcttgtgtggttaaggcatcttgaaaaacagtccgtagaactcacagatggttgtatggtgggcctatactcttctgtatttgttttctacttgctttcattttcaccttattttctgcctttatttctttggcccaaagacatctactaaatatcggtaaatgtactgattatccctaatttgcttaaactctatctgcatttgtccatgattgcatacccctttaatggctactgccttccagcctcctcttttgtcttcaatcttctttcctcttttgatgttctcattttgcctctatatagctctgtagtgtcatgtgactttaagataatctagactagtatctaaaagggcagcattaaaaggaatcaagtggagagaaagcccttgctataacttttctttgattccatcccatcagttccttcagtcccaaaagaatccatgcttgagttctatactttatttaactattggctggaattgtcgtggaatgctctgcttccatttgactttgaaacagagatgattcttaggttctttgcaagtgatataatcttgtcttacctagtttactttttaaaagcaagaagaagaggacgagaagatggtacagaaggaggagtaaggagaaatcataaagtattaaaagattgataaagtataaaaacataaaaaaatttaacacaaataccctgggtatattataattctagggtagcttcagagactgtggactttaatatgtttaatactggactgagagggattctggtagacgtaattagaagaattacaggaaagagaaacaggtatttggatcccctaaaagaaaaacaatcatcaggactcagagaaggatcttagcaggctttttattagagcagagtctggctatccttaacttattcctcaaaacctattagtgttgagtgcccatctcacgccttctcttccttcgccctggcatccctcatcaccacaattccttcatccattgcactaaaattctgttgaaatgccatccagaggctcaaaaaggatagccagctgtctttggtaaagaggtacagatgggggaaagtaggaagggaagtccccatttagtccaataaggaagagagatgcatacttaacaccctgagttagaactctaaaaatacttccaataggatatatctgcatgtattgatttattctgtaaattctattatgatgatattttaggatttctctaactttaaaatacctttagagtcttctttggaaaaggtttgaagaaaaccaaagacaggtcagaatatatgcttagagtttctgaaagatgacatagcttatgaagtgtaatattctgaaaagtgtgctctccgataattagattctttctctcaaaggttcagcttgtccctcagcaatgttactgcagattagagtcttgtccttaactttagaggcttccaggatgtcagtgcgtagagagtctgtttcataggcagtgatgccagttaacttatttgattgagaaatatttttataaactaaattttataactaaaattggtcatttatatagtcttcagttttagaggtcattaccacatctctttctaagcattccacatcccatttgaatttttttcaacaagtactcgttatgttcttactatgtcccagggattgtgttgggtaaccaggtaagacagttaaaaaaaagaatttgtcactatctaccctggttgcgatgggtaatttgagagcctactgccttccttggaaccctggaacaatggtgactatatctcagtctccctctttgtagtagaatgctaattccttgtcatccatggtcactatgataggcaggtaggcatgggaactgcgctcttggtacatgcaatccagtataaaaatagacattaataaagtatttttaaaaatgagcaaatgttaaagaatggatgcaacttatttataaaggcaaaaaataagcttttgtgacaggaaattactctgacttagactgaactttgaacgcaacagatgattcctgaggaaagttttctttaagctaagatctaaatcatacattggaggaaaatggataaagtgtgcatgtaagtgtcatgggatccttgggtgtcactttgccagccagaaacctctgtggccggcagcacctctgtctgggttttgcttgtgcccgctgggctccttgcacccactcagcctggcaggctgtgcttggcttgcactactggcccggatccccatgcctgccaagggcaagccaggcacagagcagtaagaggtatgtgagcaagcgagcatgaggcctggccactgtgcacagacaggcatgccagctgcagcggaaggcagctacaggcaccagtactggtggcagctccatgtgaggctgtggctggaccagatgtaccacaagtagcttctgctgcaggcaccaatgtctggacaggggatcgcggtggcacctgaaagctcagagacaccaggaaccacagagccccaaggagcatgttacagcatgccacaaccctggcttgaggagccccaaggtctgggctctgcaaaaggccacagctcttctctgtttctcattgcccatagcatggtgagtggggggcatgtttcagccctgtttgtgttacagctctttttgtcctgccattcagcaagtcctgagttcttgtcccatgtccaggaagaatgaggtacatggacaactggagggtgagcaaggtgcagaggagcttcattgagcgagagaacagctctcaggataccacggtgggtagctcctttccacaggcaggtcgtcccagggagtgtgcagctgtgagtagagaggagacccatggtgggtggctcctttatgcaggcaggtcatcctgaagagtcaaggagacacaaagtaggtagctccttcctgcggctggtagtcccaatgtctaagtttgtctgagtctggggtttttatgggctcggaagggaggaggtacattctaattggtccatggacatccatggataggcccagaaaaagcaccataagttctcattctgggccacaaactccacccagaactggcagcccagcccccaggcttcaggccattcttggcttgaaggaggggtttctctgtggatctgctcctttctgcccaggagccagtctgcctcctgccaccatcaacatgccatccatgtagcctaggcagtttataccaaggggtacctgcaggcccacaccgaaccatcctcagtccccactcagcctctctcccatgctcatcagtgcccaaagtccagacgggcgcaaggcagcagggggctggcatgccagcactgtcccgagcacacacataaccagtcaggttgcgacaacacctggtcttggccgcaactttgcttctcccaggagccagtgcggggagcgaggagatgccagggagtgggagcaggcacttcttagtatgtggaggcaggggggcttcccaggcccccaagagcgcaggaatgcccaggtccggagctgtggctgggtggctgcagctgcacctggaagcatggggctcccaccctgccaactcagtagggagcagcgctcctgcttgttcctggcccttggtggctccacacagtgcacagccctggccacgcctcccttgctgcagctggcatctttgcagtggccgctccagacaggctgctgctgccatcataagtgagattggtggaggtgggtagagtttctaggatggataaatggtaaatcaagagagcgtggtttataaaaacttgcatgaaaaaagactataaaaagaccataaagaaagccttttgttcttgggagataactgtttctaataaagaaagaaggagaaacatggttaagcccatagcttatagaagatgctctaatgaaaatgtcttccaaagaaaaagcaaaaccattaaaaccctatttttaggtatgttattctgtacaagttaaaagttgagagccaactatagatgtattgaaggtctgtgtggtcatagaaccaggagaatttctgccatataaaaggcatttgaattattttgttaaaatactttaatattgaagttactgcctaatattttggagaattaaaagtatatgaaaagaatgaggctaggtacagtggctcacacctgtaatcccagcactttggaaggctggggagagaatattgcttgagcccagaagttcaaagattagcctgggcaacatagcaagactatcatatcgtattttgattttcctaataaaaataattataaagaatggataaagacagagtgtattaaggttctctagaaggacagaacccactggatggatggatggatggatagatagatgtatatatgtgtatataaaatatacatttaggagtttatcatggagaattggctcacatgattacaaggtgaagtcccatgatacgccatctgcaagctgggagaagagagaacctagtagcctggtgcagtccaagtccaaaagcctcaagaccagagaagctgacagtgcagctctcagtgtgaggccaaaggccttagagcccctgggaaatcactggtgtaagtcccccagtccaaagactggagaacctggagtcctggagtctgatgtccgagggcaggaggagaggaagccaactgccccgcagggcacaggaagagagtgagtaaacttaccaagcaagctactttatccctgttctcctggctttgttctagtctaactggcagctgattgggtggtgcccacccacattgagggtgggccttcctctcccagtccactggtccacatgtcagccttctttggctacactctcacagacacacccggaagaaacaatacttcatcagtgatctaggcatccctcaattccatgaagttgacacataatattaaccgtcacaacaagtattctattttcaagaaggaaaacctggaaaacacaattttggatcagattattaaacatgaggccatgctcactggtatggtttctcacttatctcatgcagttaataaacatatttattgcctgaaggaataatttttgcagatgagatagttttctaagaactaagctacattcgctaaaattgagtcatgtaaaccaactttatatcagatgacattaaacaatttgtagaaatactttgtggtagtattaagacaaattattttgttagacttattaaattggctgatccaatggaatggaatgaatttgaggtattctgattttcctgaaccttttagcaaagcctctgcgtgatactgtttattggtaaggtgagtctatctttctctatgagtgttcgtgggtgagtctgtgttttaatatattcctttctagtatctgatttacgtgctgaaaattctggggaaggaagccatttgaggatttagctggggctctgtgtaaagtgtgcccctgtaggagtggttaatggaatatttctgctcccatattaacttagaaggtttatagctatgtcctgaggagttagaatatcatatacaaatgttacatcctattgttttaagtcagaaaactcatgtttatagttcgaaatgttgctgctttttaaaaatgcaagtagtataaatcagttgaattagtttgagatacaaagggtctgacttcccatctatagatataaatgtaaatatatataaatgtaagtgtgtaaaaatacatgtaattttgtctatataaaaatatatgtataaatgtgtatatagttaaatttatatacatctctttatgtttctatatatatacatacgtacatctttgtgcatatgtatatatatgtatatacatacatatacataaacataagcacatatgagatagagtgcacatgcttactttgaaacaagcttgatattaaggatgatacagattcttagttaatgcaatcacagactgtgatatagtgtctagattacatgaactaataattatactctatgctgatttgaatacactgtattttacgcccacgattggtactctatcttagcaggattttctcagatggcagcatcctgtgaagaatatttgtagagtgggcgattatttaattaaaaaataactaatcatagggaaatggcacatgaacactattgtgatggtgaaaaaggaaggcactttctctatggtttttcaaaatgtcataatatcagaagcagacagaagttggtaactctggatgtcttctgcccagatctttcctgagtccattttcttctaattatcttctgaacacatccttgaagtccaaacaacacttcaaactcaacaagatgaaacttacctcactgtacattgccttcctttaaacctgctttccttactgaatttcttatttttgtcattgcactggcacttatcatgacacctgtaccagaaacctagagtcatccccaaattcatccctgtcctttcccttatgagccctttgcatgcaatgtcaaaatatttctcaaccttatcttgtatttattatttcatctttgttcttgtcaacatttctcaaggtataggccatatcataagcccccaaagtccttgccttcagtcttaccgctcttccatccaatctccacattgaagtcagtgtgggttcccaagagcctgtttaatcgttctcctttgcttaaaatcctgagtcactttccagattctgatactttggcctacaaggtatttgattacctgactcctaccagtctctatagacttgtctcatgttatctgctttatgtccctcaacctgcatttgattcatacaagctgtttctgataccctgtatgttacgacctctttgcacataccaccgggtttaaacagacgactctgcttcataagatctgctttgataatttcatctatgtatagaaaactcatttcaagttttcctccatgaaattggccactctacctagtgatgactactccctctttgtgccatgtctgtaccctaattgtgtctgtttgggcaccgatcatatacttttgcagttaatattaatgtgctttactcttttattagaatctaaattacatgagatgtgtcttacacattcttgcctgcattgtcagatacaagtaatcagtaattcttgtaagataactgaatgaacctatgaacagacggttggatataattccaagaaagatttttttgacttaaaagggagagctttttgttgtaaggtaattaagaggagaaactctagaaatagacccttcctgctctgttccttatctacagtatacctttgggcaagtcacttaaccatccttggctttagtttccccatctttaatatgaagattgtattagaacctacattatcagatatctgtaaagggtaaaagggtagttgagaagctaaagcatttaaaaatcactgaaatatagtaagcaataataatattagttactattattatcatcatcagcccagagcattcttacaatgcgataagagctgtggaaagtggtgagctgttcttcattaataatatttaacacaaactggaatctcatgttcaagtatgttttaaaagaggtgacatactgagtgggaagttagacttgatagcctccaatgtcccttccaatacaggtggagtgcaagaaaataaaaggaaatactgcccaatcttatctagtagaagcataattctccctcattctgtagagaacttcagctttaaaaagcatgattctcaaaattactttcataagaaaaaacaatctgaatataatggcaaaatataaagaagtcaaatactacattctgccaattattttgaccaacagtgataatttttaaaggtgacaaatctggataagtagacaataagaatgacagacatttaatggtaacatctctttggacattgctgttagtgtcgttaatagttttaacttgtgtaacatgagtatcacacaggttacaaagggaatgtgctatatctcagttacaaagagaatgttaaaataacaaagccacttggaaagaaaatgctatactgtgaaaggtagttgttcagaaagacgataaagtcagatttttctctcatcacctaaatgtcagttaggtaactgaaatttttatagtacatatcttcgggatagtatgagaaagaaaattttatagaatgttagaccctatcaaattaagaaatagaagttatttatgaagaggaatatggttgaaacattttgatgtttcgctctagttcctaattttatatttggtgaattaaatgcatttaaaaaaaactttaaatgtgatggaaataatccacaaagctaagcatcaacatttgttgcccaagaagcaataattataattattagattattatttttcaggagttttacatgctttgtatgtaatgccaaccctatatcacaaatgagaaagccaatgcataatgaagttaaatccaagttcatatagcttgcaggtggcaaggctgacactggtattcagatgtgtgacaactcaacctgagatttctcccaatctctcaaattcatagtagaaatttgctatgtggccttgtgaaaattatgtgatttttttcagttttggtttactaatcagcaacgggggaatacagaaacctatgtaacacagtaatgtattcgtacctgtaaatttaactcattcatgcaaatactatctatctgtataaaatgcaatatctattcatatatatatgaatagatatagcatttgcatgaatgagttaaatttacaagtacaaatatatataatataaacatatatatttatttattttagcacctgtcccactcaattgcattagtacataaatatttttctcttctagaacaacactgttctagaagagaatggtttatatatgtatatagtttatataagcagtatatatatattaacacctgtcacactcgattgcattagtatataaaatttttttcttttctagaacgacactgttcagtaaggaagttgctatacacctttggctattttgagcacttgaattgtgactggtatgcttgaggaactggattttttattttatttacttaaatataaaatggcacatgattcagttattagaaaacttttgagtatgttttgatcagctttgatatgtgcattgttttttcaactgcacattgtatcaagtataaataaatgttgaatattctaatgaaatttgaacatccaaagccaatgtgctgtaagtatacagttaacgctagatttcaatttatgttaatacacggtctgttgtaatacatttggccaatagggtgttaggtagatttgaaagaacacaatgtctggattactcaatctgttttctattctgactttataatttatgagttgaacaataaattctctcatgataaaaattatcaaatgaaactcaaagataacagtgatcataatacccaccatacaaaattacaggggaaatataagcaagtatgctggaacaataatattctttttttttttttttttttttttttttttttgagacggagtcctgctctgtcacccaggctggagtgcagtggcgcgatctcggctcactgtaagctctgcctcccgggttcatgccattctcctacctcagactcccgagtagctgggactgcaggcgcctgccaccacgcctggctaattttttgtattttctgtagagatgggtttcactgtgttagccaggttggtcttgatctcctgacctcgtgatccgccagcctcggcctcccaaagtgctgggattacaggcgtgagccaccacgcccggccacccggccaataatattctttatgaatgcaagtgttaatacatttacaaaaaatttttaagtttattgatacataatatttgtacatacttatagagtacatgtgatattttgttacactgttgtatataattatatagtcttcctactctgctatcgaacattagaacttattccttctatctaagcgtatgtacccattaaacaacctctcttcattccatccacacactcttcccagtctccagtatctatcattctaatctctagctctatgagatccaattttttagctcccacatgtgaatgagaacatgtggtatttgtctttctgtgcctgcttatttaacataatgacctccagttccatttatgttgttgcaaatagctatatttcattcctttttatggccaaataacattgcattatgtatatataacctgttatctgtttatctgttgatggttctgaaaaaaaaatgcaaactttatggtactttttaaattgaagtatcaagcaaaggacataagttataattatagcttaaagacttattacagaagtaacatactatgattccacatccagaaaaagatagtatgttaccagcaaccaggaaacctccatcaagccctatggtatcataaactcttcccatctcctcaaaggtaacatgtatcttgagttataatgctgcaggttagtcttgctatatttttaacttgatgtaaatgaaacttttatatatgcagttttttaactggcttttttcactggatactatatttgtgagattcactatgttgcatatagcattactttattaattttcatcgctggatagaattactttgtatgaatataccacattttacatattctgttcagaaaattggggttgtttccagttcggaagcattacaaataattcatctatcaacataaattgtacgtatatttttgtgtatatatgtaaacttttgtattaggtatttacctaagaatagcatttcttaatcattgggtatatgcatatttagctttcaagatattaacaaagggttttccaaagttgtataaattcatattctcaccagtagtaaatgaaagtacaaactgcttcatatcttcttgaatacttgtttgttaaactttttaatttgagcctttctggtgactttataatgtcatctctcatttttcatttgtatatactgatgaccagtgaggcggaatactatttcagttgttattggccatttaaatgaactcttctctgaaatgcctgtttttctactggattttctatatttctcttactgatttattttagtttaaaatatatatattctgggtattctttgctgtttatattacatttttctttttgaatgggtaccttgccttttcactccgtaatgatatatctcttcataaacagaagtttaaatttaacatagttcacttcaatattttctgttatgtttagtgtacttttgtcctcagtttaaaaataaaactctctactttaaaattctgaagctatggtcctgggttgctatataggaactgtttgttttacctttcgtattacaatccacctattattacaggtatgaggaagggatgaatgtccattttttcccatatagatccaactgaaacaacaagttggcactgtagaatattgaggaaaagatggtcttattgcaaagattttcaataagaccatcctttcctcaatattctgtggtgtcatctttgacgaaaatattagaaataaaatgcctatacgtgcatggatcagtttatggactctaatcagttttatttctctacttgcctgtcctcatgctaattccacattgttttaattactatagcattatgacaagttttaatatatggtaatatttttttgagatggagtttcgctgtttctacccaggctggagtgcagtggcaagatctcagctcaatgcaacatccgcctccctggttcaagcaattctcctgcctcaacctcctgaatagctgggtttgcaggtgcccaccatcatgcctggctaattttttttgtattttgagtagagacagggtttcaccatgttggtcaggttggtcttgaactcctgacctcaggtgatctgccagcctcggcctgccgaagtgttgggattgcaggcgtgagctaccaggcccagcctgtatctggtaatattgtaaaagaaaaaatgcaccagacaaacaggcaagaaagactttattcaagactactgaattatggatcaagactattgccataggagagagagatggaaatcatttctactgaaagaaagacaggagagaatttaagcactgaggagagctagtagaaaaatactggaagatattagggggttaggatggtgattaggcaatctgtgattgttaattggcacttaatgaagttaggctcctactgtcccacagagactgggagataggcgtgctatcattaacaattacatttcaaagagatggctcctaggtccttgagaaagatattcccggattgtagaagatttacatctcaaagaggcagagaatatgtttttggttgcaagtttccctaaagtaagcgctctaagaaaagagaggtcaggagcctatagtcaaataaaagcctgtctagagtttagtcacattaagtttgttttggtcagttggtcagtaaaagccattttattttcttcctttttaaagattatcttgactgcttttggccatttcgatctccatatgaattttaagaacagcttgtgaaccctgcccccaaaaagaatctgctgtggttttaattggatttcatctattctctggatcaacttgtacagaatcaacatttttattatgtaaagtctttcaatcctttcatttagttaggtctttattttctctcaataatgttttatagtttttaaagtaaaggctcttaaactttctctgagatttatttcttgggtttttatatttttgctgttatgaatatatttttgaaatttcattttctatttgtgctgatataaagaaatacagttgattttttttcttggtcttgtatccaggtaccatgctacatttacttaataatttgaatacattatctgtagtattattcagatgtacatatataggttgtttttgagtaatgacagttttctttctccctttccaattatttttcatgtcattaattttccctgacatattgtactgtataaatactctagtacaatgggagtattgtggatatttatttctcattttaagtctcagagggaagaactttaataaataatcattaagtatgatctttcctgtaggtttgttgtagataccttctgttcttaatattctaagaggttttatcactaccggatgccaaattttatcatatatttttccagaatcatttgagatggtcgtatttttcttctttattctgctatatgtcaaatcacatgacttagttttctaatgctaaaaaagcctttcttcctgtaataaactaaacctggataagacgtataatcttttttgtgtattgctagattttctttgattcatagtttttcctttacgtccatgaaagtgattggcctgttattttcctttcttgtaatatgcttgctaggtttaagtacctgattatgcaggcttggtaactggcttcataactggaatttgcaaatgggaaattttaaaattaaatttttatgtatttaatacacataaaaatgtccatttttaattggaatttcaacattacatttttccagattttccgttttggagtcagctcgaatcatttgtgtctttctaggaattggtctattgcatctaaaattacagatgtatttagataaagttctatttagtccctatggtatttaatagtagtttattagctaccattgtttgaaattgaaaaaaatgtgacatgaactaagaatttctaacctctctagagaaagcaaatgatctgatgatccttagtctgtttttctacatagtaaccagagcaggagtcaagttgccctgttttctctagcacaggctcttcatttagccacagtccccattactacctattctgttacacctacattatcttatgcattttattaggtatgtacgttagaatttgtgatttcttgtggatgaaaagttgtgatgtcaagagttggcatgagacatagagggatatttatcttctatgcacttgctttcaaataagataccttttggagcccgtgctcagtggctcacgcctgcaatcccagcactttgcgaggccgaggcgggcagatcacttgaggtcaggagtttgagatgagaccagccaacatggtgaaaccccatctctactaaaatacaaaaaagagccaggtgtggtgtctcacacctgtaatcccagctacttgggaaactgaggcacaagaatcccttgaacttgggtggtggaggttgcagtgagccgagatcgcgccactgctctccagcctaggggacagagaaagactctgtctcaaagaaaaagaaaaaaaggatacctattggaatatggccctgttgtttaaaattgtaaaggtaaaaattttcaattcttgtataaaacataagctttatcaagtatagaaaaaaatgcaaaaaaaattatcattaattgtccttctaaaatgtttcactgtgttctatattaaaattctatcatgctccagatttatcacatctggaataaaggctgatttttttatcgactgagctctaaatccttactatcacaagcatctcaataattcatcacagatttaagagcactttcacatttattgatctatctgaccctagcagttacctgtctaggagagtctgtactattatctctatttcactggtgagaaaactaaagcacagcaagattgagtttgttcacagatattacaaagttgggcaacagtagaactgaagtgggaatgcaggaagtttatactttatgtaatgattagcagattgaaagatccaaaaaagatggttctaagacaaaagttgggtggggaaagccacctattgataacgacagtagtagtattcagttttgggatatttgtgcaagacattaacctcaaaggtaaggagcccacctcaaggagctcagagtctgcgaggtataaaacgataaggaagaggaaacctcaagctaccaaggaatgcctgggaatgtgatgaatgctggaaggaacactgttacgctggaatgctccttagaactcctgctctttattttctggtatcccaattgaacagactggtgggagctggagagtacagagtttattaagctgccaaaaaaaaaaaaaaaagacattaaataatatcctgcaaagaataacagcagtgacaacaacaaaaggcttttccagatttattcattagcactttgtatactcacacaaataaataatataggaaactgactgaaatagcgtagagaagaacatgcttcttcgtgttaaaatctcactacactttcagcacaattgcaaaggcagaatttaatgaacaaatcagtcatacttaccttttaaaaataagtcctgcaaaggccacatgttcttaatctggaagtgcaagtatttgctgacgttttatgattaaacaaatacagagttacagtgtcaaatgtttttgaatcaaattataacattaagcttcacatccttgtgaagcagattagattaaatgttaaatctagtcaaacttctgctaaaacaaaatatgaaaagactccaaagggattcggcatctggatatctcactgtaggttgtgtagcacaaattagaaggcatatcttttataatgaatgccctactgaatgaataccattatgaacgagcatgaacttgtagccaaatggatctgaggtcaaatcccagacactcagtactgtggcttctgtgacctcagacaagttacttaacctatctgtcagtttcctcatctgtaacctgcccctttggaagtgacagctaaaaattccttgagttcagacaggagattattacaggatcatttaaatagaagtaagaattatacttttgaaaaaacttccagtagttgtttcataactcatcaaaataggtttatccgccctgtaccatatgttatacagtgaagatataaggtacaccattttatagtatggtgcttcagttcagtttgtagaaatgtgtaaaactgagaaccaagccatacccttggctaaacactattcagtaggactctgccacatttctgcctcataatggatttttgtttttttcaatggtttttgatgtgatttccatttcaacatcagtaagagtaagttgcttatacgttttaactgcatagttgttgataaagtaagagaaaaatcaagaaataagggattttcagagggctcattacacataaaattcatttagcagagaagtgtattatagggtcttaacctgcaataaaataagatgggttgttttctgcctccctctttcataaagccccgttgctgatgcattgtgtggtccatggcacataattgtttccgccttagtggatatacgcctgggaacactctatctcttaacgccaatactgatgggcacagtttaggtttcatattctatccctggctccagtaaattcaagggtcaccatacttaagatttacctcccaggcttgtcagattttcctcagttacctttatccaaatgttcttttagtagccatttttcacttttgaattgaaatagcaactcaaccaaacaaaggaattcagatgagaaatgtccttggcacgtacaacaatatgacatgtgaattaaatgggaggaaaaaatcctccccgttgtggatctgagcatggacgataatggagttgtgatttagtccatgaaaatgttagacgaagtgagctgacctttagcttcacttactgctgagacaaaatgagaatataaataaaaattaacttcttttaccattttgtgagactttgtaattcattggttttacatttatgtgtagaatgtttagctctataaaaatatgcattattgctaaaagctcaagggattcctatacgtaaatagaaactcagagaaacagagttgaagttacatattttttttttctctagagaagaggtttctaatcctaatacagtggttctttaaaaaatatatgtattagccccattttatccaatttcttacacttgtctaacaattttgttatagccattcaggcaatgataggaaccagcatctttgagtgattccagagctgagggatatagtcttccaattgctttgcttcattctttgtaattcaaattaaggccaatattgctaagcaataaataggtaaatccataaatttaaagcacttcgtgtattatctatttatacttgtgcatatggcatcacaaaaatgtatgggcagatgtttacagcgtatgagcaagtaatttctaattcacttttccgcttacactgagatcagtggaaagcactatgcctgccttgctacagaagtgacttagattcaattcattgagtattttctaagagtaagataggtttaagcaatagaatatgttactaaaggatatgtgttcatgctgtcttgtgttggaaacctttaaagaatatacttgaagactaaacatttattcgtaaagatttaatgggtgcctttctacagtgaatacagtaaaatagatgacccttggcagttcttagatttgatgtaagaaccatgatcaagcaaattgtaaacaacgaccaactcttaaataacttgtttcaaattaataatactttcccatacatactcttgtttaacatttgcaattctttaacgggttggtattattattcgacagacatttagccaagtatttcttgaaaaagaatccatctatcttaattgtcttttgtattactcctttgtgagggctatcattaaaaaataacatggactggtggcttaaacaatacaaacactttctcaccattctgggggccagaagttcaagaccaaggtactggcaaggattggtctcttgtgaggcctctctccttggattgcagatgaatgccttgttcctgtatcctcacgtggtctctcctctgtgttgcacatatccctggtgttttgctgtgtccaaatttcctcttctcataaggatacccatcatattggactagagtaaccctaatagactcattgtaacttaatggtctatttataggctctatctccaaatatgggcacattccgatgtagtaggtggggcatagggcttcaacatggatttcatgggacacaattgagcctgtaacatcttctcttaatatttggcatatccagatatttggtacatatttgttatataataaattcatgatcaatgaatgaatgcattgatggctgtcattaactgtaacctagatattagctgaatcataaacttgctccattatttggatataaagaacactttaagtggcattttttaaatagttatgttaaataggttgcctatgtacctaaaagagtgtttaattacagcaatccctccctccctccctccctccctccctcatccatggttttgctctccttggcttcaattactggcagtcaaccacagtcagaaaatattaaatgaaaaattccagaaataaacaattcataaattttaaattgcatgctgttttgagtagcataatgaaatcttgtgctatcccacctctgtctcacccaggactgaatcacccctttgtccagcgtcttcatgctgtcaatgttacccgcccattactcagtacctgtctaggttcttagaaacactgtcatggtatcgcagtgcttgtgttcaagtcaccctagttttacttagtcatggccccaaagtgcaagagtagttatggtggcagttcaaatatgccaaagaaaaactgtgaagggttttctttatgtgaaaaggttcccaacttaataaggcaagaaaaaaatcgcatgctggggttgctcaaaatctgtggtaagagcaagtctatccgtgaaattgcgaagaaagaaaaataaattcataaatactatatatagggttttgtactacctgcagttttaggcatccacctgaggattttgaagcatatcccctatggataaaggagaactactctattagttttttgtgactcatacagtgaacaaaactgcaatattaaatgcatcccattagtacatctcagaatttcaataaatttgaaaatgttatacaacctggaataggggatctttatttggatttgtattcccactaaaattaataaattatacatttccacctatggggttacaagcttaaaatgctgcttcagtggatactatatgtcttgtagcactagagagaagatgctatatatacttgaaagtcttttttgtttatgaatatgatgctatagcttgagtttgtcccttcttcccttgactgtcttcttcactggagttgatgggctacaataaatttcccacattttgactttgtagatctgcatcatcacgtcaggtagatggtgtagtttatacttaagagataagattttctccatttgaagcttttttctcccacaactaatctattaaccattttgttacgtgccattttacctgacatgcactgacagggtcactaggaagttagctaaaaaaatgcaagtatgttttagaaaaaacctatatatactgcttcgtaataattagatggttgaagtgactaaattcattgatttaagctcgcacatttcctgtgggtatctcgcatcactgtttgagcgctatggcttttattgtaaacataattcaaaataagttgagtagaaagtgaaactacaaaaaattaacagttacattatgctgaaagcaataacattgatatttatgaagaaaaactgaaaactcacttatgattgagctgcatataagtacatgattatgttaatactgtaggaaaatgttgactgccttctgtttacccatgcgtgtatttttttttaagtggtgatagattaaacaatttaagaaacgtgactctcctagtcacttagaaataggtggattagggccaggtgcagtggctcatgcctgtaatcccatcactttgggaggctgaggcaggtggatcacctgaggtcaggagttcgagagcagcctggccaagatggcgaaaccccgtgtctactaaaaatacaaaaattagccagacatggtggtggatgcctgtaatctcagctactggggaggctgaggcaggagaattccctgaatccaggaggtggaggttgcagtgagctgagatagtgccattgcactccagcctgggtgacaggagcaaaactctgtctacaaaaaaaaaaaaaataggtggattattttcatgatgctaatttcatttgcattgtttaaatcatgtgttaatatcctctaggtgggttaatacacatatgtagtataaagtaacatagaaattatgagaccttagacactgagtagatttttcaaaaatatgagttataaacatttttctaactctaattctatataaaataaagcacgtcaatattttatgatttctagctttaaaggtccaatatatatatgagaaaataagtttcttatttatatgaaaaagttacaaaaagttgaaaattcaggctataaagtgcatcataatgaggttgagctaactgccattttgaaatgcttcctttgcatagaaagcatcacaatatttgttttccttccaaaaatcattgatagttggtttatgttacatattaaaatagtgtgtgttcttagacattagtgacatgttaatgatatagtagtttttactcagagattgttagttttctcactagagtagtttagaaacagaaaattttaatacttttgtaataattgagaaaattgaaaaatctacatagtaatagaatttaagttactaagaattttcttctacaatccaaatggtaggcaattctcattatgcaagattgtttcaattaagagtcttttgaggcattctatttagtagttagacttttattctttagggtgtattttcaaacctaaggaaaatacaccttttacttgttctcactgcaaaatcctctctatatgtatgtctttgttatcttacatttgctatggagccattttatatagtggtataataaccacttcatattgcttgtctctttgcttttctatgaaaggtacaagacttggtgagataaagacaaatgacagtcacaccacttatttaaatgtaagcagatcagaaagagtgtcccttccaacttctagcgtacataggagactgagatactttggcaaattattcatgccatttttaataaaacgtagttaccaattgtttgctgatgctgtgcttgattgtctcttctccaggtattgggagatcgatgggcaaacatctgtagatggacagaagaccgctgggttcttttacaagacatccttctcaaatggcaacgtcttactgaagaacaggtgtgtcatgtgtgagaaactagctgtaaaagacacggggggatattaaattggaaaagtaaagatttatgtttatttattccttggaattctttaatgtcttgcagtgcctttttagtgcatggctttcagaaaaagaagatgcagtgaacaagattcacacaactggctttaaagatcaaaatgaaatgttatcaagtcttcaaaaactggccgtatgtactttctagctttcaatggtcttataaaaacccagtactgtatattatcactattatttagtctcttctatgctattgaatattaaatgtttatttttgcttggatcatagattattcaaagatgttatattgctacttttctgaattaaagtgggaaaaaactataggtggattttcaactttgtttttcaaagttgtactcttgataaaacatagcataccagaataagacttcaattaaaattaataaagtaatactaagaaatgtctgtgagcctttcataaagttctaagcagcatagttctaaaaaaatagactgacgttgattctcagaataatatgtgagagttacaagcgacggttatcctgacattgatggagtttaaccttagtttattataaaggggtacctgagactgggactgggtaacttatgaaataaagaggtttaactggctcatggttctgcaggctgtacaagaagcatgacaccagcatctgctcctggtaagtgcctcaggaagcttacaatcatggcagaaggagaaggggagccagtgtatatcacattgcaagagtggaaacaaaagagataagaggaaggtcccagactcttttaaacaaccagatttcatgtgaactaactgaatgggaactgactcatcatgaaagggattgtgctaagccattcatgagacatccgccctcatgagccaatcacctcccaccaggccctacctccaatgctgggaatcacatttcaacatgagatttggagaacagagatccaaacaatatcacctagtttttcaagcaaaaaaaaattaaagcctatcaaatgacattgattataaatacctcgagtgttttgagaatgagatttctttggcaataaatggatttcagaaaagacttcattgaagcatttggtttcagcaggaatttccaagatttaaaaaaaaaaaaaaaaactctaaagtttctcttactctgtgaattttatcatttctagtaaaagaggccggtctgatactatgagtttaatttttcacgtgacatattctactttatgatttcttaaaatttttgatagatttgattaaatgttcatttgatatgaacttttataaaacaaaatggttgtaagtagtgttccataatttcacctttattattgcattgtacttcataataatgcaataatttctaaacttaagtaaatttttccactcattttaaatacgtaccattttaccagctatttatttgtttcatacattttttttgctccataaatgctaaccctcattggtcttttaatttaaaatagattcacttatgtattacttgttattacaagctagcttattattgataagaaattattgctcaaagaatatggactttattaagtgatgtgactgccgaaaatagagttcagaaaagtaacctgtatatgtttgaaaacacgagtgcaaaaatatcagctgtatttgtagttttggcctgcagctgatggggagccattgagagtttgcaaaagaatcatatttgcatttttgtaattctttttggtaggaagatgtttgatggtacgaggactaatcagaagacctgaactaagtagcattgggcattaagataagaagagaaacattagaatgttaagatgtgatgaatgaaacttgtgataagaggcagaagtttgaaatggttcctagacatttcatttgggtgactgggttcctaggagggttattagccctaacaggagaatagaagaggaattgctggaatgacaaaaatgataattatttcagatttggatatattccgtgtaaaatgtctttgagacatccaagttaaaaatcctttccattaatcagttggtttacacaactagaatctcagaaaatggttcatgactagttattgattcagaagcaatcaaaatgcttctgagggattgtgtagagtgacacattaagtgaaacgaatagatttcagggaggaatgtctacaatcaaggagtaggcagaggataagatgttgaccaaaagattgagcagataccacaaggggaaagtggtatcacaaaagtgaggagaataaagatttcaaaaaagtaggaagtggtacacactgtcacatgccacagagaggagaggataaattcatgagggattctatcatatctagaggaatggatgcatggattacatctccttaaagcagaatattccttacaaacattgttcttctcaggcaaaatgtgaatcctttcagtaaataagtgagtgaccactgattatcaaaatgcagtcatgccctctgattaggagcgaagatatattgctagttaaatacagaatcatgtgcttcagacggtcaatcataatggtgatggtcagtcatattctgtgtgctgaaaaagtcacaagcctgcccagattcaaggaaaagggaattagatttcatttcctcatggagaaacaccaaggtcaagttatagcaaagcatctgagatgaggatattttacagccatctttggaaagtaccacatgccagaatagtacagttattttacatgatgataaattccaaatcttaatatctagtcaaagttcctgcatatattgttgactagatttaccaatcaagaaagttgttcttaggaagccacaaactgacaaaatccaaatatgttaaagctagatgagattttgcatctcatctagtgtttcttcaatctcattacacatgtaaagttcattaggaccatctactcagtttgtttccaagagaaaatcgagatcaagaaaaaacacaggatctgtatcctacaacattagtatcagacttaaaatgaacactaagacatccagactcaggtccaggcctttcaatctatttcagtagtcctcatatcagttgattccttggaaaaaataactgcaactgagaactgtcatttctaacaataatgtgcctctatgttaacatttttgtgagcagaaatcttggctagcctcagggccataaaaatgctcttttaagaaagtcaataattttccaataggattaaaatttgtgttatgtcaccttgcttgtgaacaaagagaaaatatgttttctataggtcttgtcatttgatagtttaagccaattaacaaaacctgacagctggtctagaatttgaggtaaaattcctttgctgactcaggcagtgaataagaatttaatgttcattaaaatatgtcacaatctgagacccaaaacaggtaccatctgtcaccagttttcactacatgtctaggtatagatacactgtgctaaactctcttctctttacaataagtgtaatttgtttcaaaatagtatcactgataacccatgggattgtgtcctgcttgccattgaggtgggaggtggggattatgacatttaatttgctctagatctttgggattcatatccaaatcatgtagatctattattttttataatcaaaactgatttaagttttaaactgatttggcatcagggataaaaatgaagggaaagaagaaacagtagcttttatgaggtgaattataagacttgtagaatcacgtaaattatcgtgggaagatccaagtcaagaagaaacctgttcctgagtaaatgtatttctgctgtggggactgttggcgtttgctggggaaggacagctctggggaagcagggtgatccaagagattatggtatataagggctacagaagtacttaggaattgaagatattctcaaatggctgtgggatcaaaggacatggatgaagtgctcatggtaactgagcaagttcctgtttgacttgctacctttacctcaactcctgggatggccctcaaataattaattcagacaggatcaatgcttctcaaaatgtgttcccccgaccggcagcatcagtatcaaggaaatttgttaggaatgcacattgttaggccatcttcagacctactgatttagaaactctggaagtggagcctagtcatctgcattctaacaagcctttcaggtaattctgatgttctttcaagatgagaacctctgtaatagatcaacctcccaaagtacaactggtgattagaatgaattggagcacatcttacatgtagataagtaactacacataatataggtggaaaactcaattttgccaatataggagaaattgtcttggcattattctcttatgcgtattcctgatgagagtgaggtgaaggtttcctgggccttttgtaaggatacattatcttttcacttcaaatcatcttgaacagcttatctgtctcttctccatatccactactgacccagtctgatttattgactgtaccttcctccctaccttggaggtaggtctacattcctggcttctataaaaataaagtctgtttattcttttactatcccagctggcctttgccttgtacacattctctagatcttccttttgccacctgaattttctagagctctatgggtctctggcactcatagacctatggttaattattgatatgtagaaatacatattttatgcaataattagtaacaaatcatagttatttaatatgcacatgtaagacctaagcttaaaagaatcagcatcaatggatagacaggacaaggtaattctaatgaattctatgatctaatgtatctggccccatcatggattttctttcttttcctccctcagttaataatcctgggggagttctggaactgggagatgactactgaaagacagaaaaagagagagaaactgagaccaaacaactaatctgccatcatcatttttgatactcatatctaaaatttactaggtataagtctgggttcagtgtttttgtcatacagacatataaaaattcatttattcaataatcacacaatgtaattataacattgattttactttaccttgagtgcacttttttcctaattggatttttttttttttcttgagatggagtcttgctctgttgcccaggctggagtgcagtggtgtgatctcggctcagggcaacctctgcctccctggttccagcgattccttgcctcagcttcctgagtcgctgggaccacaggcatgcaccaacattcccagctaattattgtatttttagtacagacgaggtttcactatgttggccaggctgatctggaactcctgacctcgtgatccgcccgcctcagcctcccaaagtgctgagattataggcgtgagccaccacctctaattttatttttaatggtgactttcactttcatttttgtaatgcttaccaaatgtttcttcatgtggcttaataataaaacaggaggcttattttcatttgtttaggtaccatgaggttactcataggtttttattgcaatcctcttctttaaacataattctcacactcctcttctgacatgtttccaaatcattacatattttgtttaaataatgggtagaccattcagccttacacatatggctatttaaaatagtttctaacattctgagtaagtaagtcaaagaggattgtacttagattttttttttatttttagatttgtgtctttgtgtatattgtgcctctttccatagtaaagaaaaaaaatgacactataactggaggaatatacattgaaattcaaatatggctctcagcttgggacaggtagcatcaacctttgttctagtactaatgcaaatattcacttaaatttaatggaaaactaacaagtgaattaaacaaaatgaatatgcaaaacctatctattgggctgggtatggtggctcatgcctgtaatcccagcactttgggaggccaaggcgggtggatcacttgaggtcaggagattgagaccagccaggccaacatgttgagactcctgtctcttctaaaaatttaaaaattagctgggcttagtggcatgtgcctataataccagctactcgtgaggctgacaggagaattgcttgaacctgggagacagaggctgcagtgagcagagatcatgccactgcactccagcctgggcgacagagttagactccaactcaaaacaaaaaagaaaaaccacctacctattgctaaacccccacaccgtgagttttattttgatttgaattcagtgtataatatcttaatttgtattttggtctattgcattctttcaaacttagaaaaatactgaacttattgttaaggaaaaattagagatgaaacttaaatcttgctttgtttccccttaaaaatggcatgaagactgaactataacatactccaggtgaagcagattctgagtaaaagacaaactaattgaaggagccactagagcattctgcagttcagagctatcaatgcaggtgccatgccaaaatgggctacttagattgtccttttcaggaaggtgtattgactgctctaggtttggggcactttgcttcatgggcaattggtgcatttgtgtcatgacaatttgctctgtggtatgttagttcttaaataaacttacatttgtttcggaaagacaggtatcgcgatttagtttacattcattgtatttgctgccaaatatggggttgttaagtggctgtaagataattttctcctttatttctcttccttcttctcctttgtttacagattaagtcagggagtaatgttcagtacccaggaattgaatttgtctgtgtatcaggcaaagttactgagtcaagtaaaagaaaaactgccctgatttactgatttcacataaaccacttattcctttcaaatcaaccaaagggagtttgtaaccctccacagctcacaggaactttggaaatataaatggtataaaaattgcttcataagacacataagtatttataaactctgaaaagagatgctgaagcatttatgtcatgcccagcgacttagttcttttacttaatgggctctacaattagttttaaaaaataattactcaaataaccagatgttaattgattaatggatgctacaaaaattttatggtcagtaaatcacataatgagattttatctccaaataatgaaccgaatgttaaaactgtggaaacaataatattgtaattttatccaaataatcacagcatttcagaatggcaagtttccttagccattctcattttctcagctcactagcttttcttcagtactcctggtacctgattgtcagttttcgtttgaattccgtcaggaattaaggggaaatccaagatccgtgccttctaatttccacatgttgatctctgttttgccttttgaagcaatattaccttttcacttggattttcttcaaatatttcaaggtagctcttaattacctctagtaggtctttattctacgtttgagtttcttttctcttcttttctcttcaaacttcttgggataattagatagattataactttctacctctatttttctgaacttttgatcctttgcgggcacgattgaaatattttcttatctatgcaaatgagcaaatacacgcaaaagcagattgaactatagtggtgtatggaatgcaacccaggcttattctgtgatctttcttgttttaacaggttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggttagtgataccaattatcatgctacagactatctcagagattttttaaacctgcattaagagagtgacattataaccctacaaaagaagcaaccagattagtttttgccctgtgtttagttaaataaaaacatgattcttttgcctgtcttgttgttggagaatggtggtgaggtagagtgctaattaactgaacttgttactgccctagagtgaatttcttccagcccaatagtaacggggaactgagtgacttagagcaggcgaacaaaatgctgggaactgtataatcacagtctaaccccaaatcagagattgctagaaccacgaggaacattagccaactccgttttactcttgagaaaaatgaaacttagggaagaaaagtaaatttttcaagagaagttagtggtaggagaactagggttcaggtcttttgatttcttggaaagttttttattagtgtagttaattatctgactattgtaccttttctgccatagactgctgatttcataaaattatgaatgtggcttagttatactaacacatacgggctgtagattatgaaaacatctcagctacatttggggtatgtggttttattataataatttttaaagatttagtcactaaaatggggtatcgttaaaagttgaacctctttttgtcttatgtagttggatggtagaataatgagtagtcattcaagatataaacattatatataatagtatttaacatattctgccacatagcctggcattataaggaataactttactcaaaattcatagctcaatgcacaggcatacacttccatattcaatagattttaggcaaatatttcctctatattgagacaagtacatggaatttgttttcttgagacctgacatctgataagtagcacttaggaaatgccttttggagacatgaagtttgtagtattgcctccaggaatacaatttaagacagcgtaataaaccagcctatatgattttcaatcacagttcaatgttacttttaatccaattttacgttaaaaaattataatttgaagaaatatgaatataaattgtaataatttcccacacaatcattacataataaaaactccatttgttttccattaaacatactttagcaattaattgacctaatagtagttttagtactatattatgattcctcctgttttatgtgatctgcccatggcttctttgcaatacattggtatttatgtaataaatacatgagacattagtcaatttgatactttttaacccaacactgagagtattcccatatgtacccattgcttccacagattattgctgccataaaatggtcagttgccgtgttaagaaagattgccattatttgataaagaaagttattttgacgtgcatcccttttaagggacatgtttagggagctgtaacagttaactgtaggtcatcttctagttcatttgcattgcatggagtggttctcaaacttgagtctgcatagtagccacctgaggagctaattaaaatgcatattcctaaacattttgctcagaaaatctcatccataagctgtgataaggacctaaaaatctacatctttactaagcctttgatacaatctgcagaccatagaggggatcaacatacactgggatctacttgaggtgggagggtgggaggaagtagatgagcagtaaataagactattggatactgggcttaatacctgggtgatgaaataattggtaagcaaacccctgtgacacacatttacctatgtaacaaaccttcatatgtactcctgagcctaaaataaatgtttaaagaaaatagacagtgatatgtgtgtgaatcccaacattctggttttccacaatgctccctgaaatgtgaaaagggagagcttcttgggaatacactatataaatatgctcattcccttggaatgggactactttttgatgaagtttgtacatgtcatcgaaatattactgatttgattattccaattggtagaaaagcatttgaagccttatttttaattccctagaaattatgagaccaccacctaggcaattgacgtgatgtcttccaacttgtataattctataataaaagaatactggttttgatttgcatggttctttatgaaataaagtccaacatgcattacagcatgtatctcttcacttgctcatagggatacaatgaagataaaatggaggcatagacaagaaagcatttgaggggaaaaaggttgagtttgatatgtaagtcatgtagttcagtgtgtctggagggctttttgtggttctctatctgcttttttttttttttttttttttgagatggagtctcactgtgtcacccaggctggagtgcagtggcacaatctcagctcactgcaagctctgcctcctgggttcacaccgttctcctgcctcagcctcccaagtagcagctgggactacaggtgcctaccatgacaccccactaattttttgtaattttagtagagatggggtttcaccatgttggccagggtggtctcgatctcctgaccttgtgatcctcccacttcggcctcccaaagtgctgagattacagacataagtcaccgcgcccggcccactatctccttttaattttattttcaaacagttacacgctcctattgtgggctagaaataaataaaaggacttaacatcatgtaagttgttttccagaacactaagcttgagtttttcttaagcttatgtttcagttttctctcattgcctttccaaaaattatgctgtcatgggattgatccaaatctttgctggctgtttttgagctcacaggaaggtagaaatggagctactcaggaaaagagaaattaaaaggaggtaaacagagacaacagcgaaatagtatcatataagagcaactgattttcttttatccatgttaaattgaccttgattaaaattacataaggagaattccaagaatatgagctgtaaggttgtgactttgaagaacaaagctcacttgtatgtacattttctataatgattgtgggagaaaaatgagtttcattaatgactactcacatgatatactcaattgtttcaaaaattcttttaaataattagtataaagaatgagcaaagttctcataatggttaaaacctattgtgaggcagggtgtggaaatcgtgattgagatgacaaggcacccagttgtactcatataaagaacactgcttgcgcgtatgattgctgttcaggtcagagctttgaggcatttttgaccttttgaagcagttgcatggcaagagatcaaaacgtgaaaaaataatcagctaggaggactgctctcttgcatttcaaactcagatttgacttgaataatacctggacacaagctgagggtatttaagttgattagaaggtagcctaagaagatagaaaatactttttttctaaatgttggagagataataactcttgctatctggaggcttacaatgagaaaagagggcaaatataccctggattgacttctttaaaaactcaaatgatcatgattccctgtaattttttataaacatacttgtaatttgtgcagttttttctaattgccttggccctgatcgatatatattttatcttgatcataattatgaaatacgatagtgacgaattccatcaacatttgcttgtctggaaaagattttattcttccttcacttatgaagcttactttgtctggatatgaaattctgccttggaaattcttttctttcacggtgttgaatattagcccccaatctctactggcttatagggtttctgctgagagatctgctgttaccctgatgggcttccctttgtaggtaacctggcctttctctctggctgtccttaacattttttctttcatttaaacctggagaattgtatgattacgtatgttggggttggtctgctcagtatcttgcattccctgaatttgaatgttgggctggcttctgctcagtgagtatcttgtatttcctgaatttgaatgtttggctggctttctagattggagaagttctcctggatgatatcctgaagtgtgatttccaacttggttccgttctccccgtctctttcaggttccccaaacagtctttgcttcagaatttacataatcccacatttgtcagacgttttgtacattcatttttattcttttctttttctctaatcttttctgcctgtcttatttcagcaagatagtcttcaagctctgagattctttcctctgcttggtctattcaggtattgacaatgtgatttcattgtggagttgtcgtattgcgtttctcagctctatcaggtcattcatgttcctctgtaaactggttattctggttatccgctcctgttacgttttatcgtggttgttagcttgtttgcattgggttagaacattctcctctagctcagggaagtttgttattatccacctttgaagcctacttctctcaattcatccatattagcctcagcacaccatctcacgccagacagaatggtgatttttaaaaagtcaagatacaacagacgctggcatggtttcagagaaatgggaatgcttttacactgttggtgggaatgtaaattagtttatccattgtggaagacagtgtggtggttcctcaaagaactagaaccagaaatacccagcaaggccgttactggatatatacccaaaggaatataaatcatcctattataaagatacatgcatttgtatgttaattgcagcactattcacaatagcaaagacatagaatcaacccaaatgcccatcaatgatagactggataaagaaaatgtgatacatatacaccatggaatagtatgcagccataaaaaggaatgagagtatgtcctttgcagagacatggatgtagctggaagctgttattctcagcaaactaatgcgggaacagaaaaccaaacactgcatgttctcacttataagtaggagctgaacaatgggaacacatgggcacagggaagagaacaacacacactggggcctgttgctgggagaggaggagagcatcaggaaaaatagctaacggatgctgggctcaatatctacctaatgggtctgtaggtgcaccataccaccgtggcacacatttacctccataacaaacctacacatccaatacgtgtaccctggaacttaaaaaaataaatgtgatagtaagaaatttattataattaatattttaaaatataatgtatgtgatttgaagcattactttcctcatttgactgaaatcacatgtgctgttgaaagggtatattagtcatatgctttacaatttggtatgctaattgtaattatcatattacgccataaattgtaattactgtatttaatatgtaatttatattaagtagtatataccaggtgctttggtgtaagcatatatatatatattttttttttcaagcgagtctaaaggttttgtagttttgtggatttttagtagaataaattgtcttctttctcaggaataaggaaagttgtatgacttattaaggttcaaatatctcattcccattttgtgaatattttgctatattgctaacaacaatttttgcaacattctcaactgtgagcacctctttaagataaaatacatatgctcagaatttgcctcttcttgtacatggcagttcatgtttatgctgtatatgtttgtgcctacattcaaggatgcccaaaaagagaaaatgattattatataattatgtgtaccttctatatcatctatatcctgatgagagatttattatgtgtgctgccgaagcaagcacctgatgggagatttaaaactcctatcaaatagtaatataaaacatagctgtaaatgataagccagtgctttttattatacccaaaatgcaaatagaaatatgccaatgtaccaagatgaaaatttctttacatgttcttcttttctgagttaattctcattctttaaagatcctctattttaacccttcataaaatattttatgttcacgttctggctgtacccattctcagagcatcattttgtagacctctttgtacaagggggatatagttgcaaatggtttgcctctcttcttttttggccagtaagtttaattaaaaatactctaaggctttttatttaaaagaccttttcattgcttcctgaaagctctccacgactagtaagcctgatgccaattaaaaaagaaaataattttttaaaatctggaattaaaataaaaataccttacttattttgtgtttccttcttacttaaggtcatagaattaactcccttaaatttgagaacatgttttgggtaattcctcaggttaaagttttattagaaaaatttgaagttgaccgagtgtggtggctcacacttgtaatcccagtactttgggaggacaaggcaggcaaatcatctgaggtcaggagtttgaaaccagcctggtcaacatggtgaaaccccatctttactaaaaatacaaaaaaagtagccaggcatggtggcaggcgcttgtaattgcagctacttgggaggctgaggcaggagaattgcttgaacccgggaggtggaggttgcagtgagccgagatcatgccactgcactccagccgggatgacagagcgagacttcgtctcaaaaaaaaaaaaaaaaaaaaaaaaaaaaaagaaaatttgaagttacatctcaaataactttggaaattaactgtatcattttgctatctccaactataataggtatttgagaatgggccttgtatatcagtgcaataggttttaccttgtaaatgcattgtctgtaacaatataaaatgtaagcactaaaaaatttaatacattcagtctgagttaactcttggaatctctcattctttatttataaatttaaaggaaaggtaagctaggcagatttctatagtggccatcgagttctaaatgtctttgatatgtttctctttgcttttatgtgaaactctggagtacttagtgaagaagattcctacttttgccactggaaaggcagctaaaaaataatgataataacatcctatccctattcaaaggagacttaattatgaaattattacactgtattcactgagtatgtcattaaaataccatacagacaaaatgctcagcatctgtatgatacgcctattatctcctgacaaaaaaatgaaataacacataaagacaaatacaagtctttttcctaagcctatacttgataatatccatccctaattatagaatgtgtttcattacttcagtgttagatggtatgtagaggaaggccagatggatcagaaaaattaaatctcattgctttgcaatttttgcaggtgcagttaattcacacagttgctcaaattccgtatttaatatgaatccagaagacaacatacatctcttctttctgatacaatttgtactaaagacaatttaaaatgaggaacaaaatacattaaattggacagacagttttacagaataaaccttcttaattatcatataatatttatttcgaagaaacaaatgacttatgatgccttctaagtatttgacaataattttgctcatgatttcaatgtcagtacttattcaagaaattttattaccttacagtaataaattaattattaatataaattaaattattattaaattattgtaataataaattaattacagtaattaatagtaaattttagttaccaggctactgtcctgaactttggcactcattgtatgctacattcagctatgggaagtcctctatacttcataagataaagcattttacatccttgtgattagtaactcagcttcctttgtgaccatctgatcttttgcccaaggattctcccaaagttcaacatataaatattttcttttgcttagagatgcaaatctttaccagatttttgtgccttgtgctaccatgcctgtggagttggtttttaagcatggctatcaattattatctaaagctgttgctatgattatgcagtatgttttaaactgcagaagtgcaattcctccatgcccattaaaacttattgatcactccaaagggttacatatacatagacagacaacgcaatgaaaagccttgatccacagttgtcaacctgattgtgtgtgtgtagtgtattttgactaattttgcacagatttcaatatagcatgtcaagagccaaacatatttaacattgagtaattcttcctatataatagttatgatgtgccattgtttacaatttcagtattctgaatttatatatgtgtgtgtatgcatacaaatacacaccccttaaaaggaaaccaccattcaaaaaagtgtacaagtgtaggagcaagtgagcatagctgataagagttggatgaatgaacattcagacttggatttatatctatgctttgctactaaaaagttttatctgcctcaacaaggtcactttcatctataaaataggaataatattagtacttactcttagggccattgtgaggtcataatagctaccatttattaaagctttacaacatagcaagggagtttttctagatcttttgaataagataatcaattcaaaacacttattgtaatgcctggatcatgcagaaagcttcataactggtacctgttattgcaagtattagtatttgcaaaataaagattttatgctaaattagtaactaatactttatagcttgaatctttctagtaagtatctaaatattcaaatactagaatatctcaaaaggcaagaagttgaaatctcttatcccagcataacaaaaaagttacaaaggcaataatatgtaaataattaaatggaaagttaaaagtttcaattaagaatatcagtcaaaaataaaaggaaaatttattagcctgttcttacactgctataaagacatacctgaaactgagtgatttatgaagaaaagaagtttgactcgttcgtgtttgtggcattatagtattccttggtgtaaatgtaccacattttctttatcttgtctatcattgatgagcattaaggttgattccatgtctttgctattgtgtatagtgttgcaatgatacacatgcatgtatctttataatagaatgatttatatttgggtatatacccagtaatgggattgctggcttaaatggtttttctgcctctaagtctttgagaaatctccgcattgtcttccacaagggttgaactaatttacactcccaccaagagtgtaaaagtgttcccttttctccacaacctcaccagcatctattgttctttgactttttaatagtaaccattctgactggcgtgagatgttatctcattgtggttttgatgtgcatttctctcatgatcaatgatgttgagttttctttcatatcgttttaggtcacatgtatgtcttcttttgagaagtgtttgtttatgtgctttgcccactttttaatgaggttatttgtttttttcttgtaaatttgtttaagttccttgtagactctggaccattgtcagatggatagatggcaaaacttttctcccattctgtaggctgtttatttactctgacggtagtttattttgctgtgcagaagttctttagtttaattagatcccctttgtcagtttttgcttttgttgcagttgcttttgccattttcctcatgaaacctttgcccatgcctatgtcctgaatcttattacctaggttttcttctaaggtttttattgtttggggttttgcatttaagtctttaatccatcttgagttaatttttgtatagattgtaaggaagaagtccactttcaattttctgcataggactatcccagcactatgtattaaataggcagtcctttccccattgcttgttttttcaggtttgtcgaagatcagatggttgtaggtgcgtggtcttatttctgagttctctattctgtttcattggtctatgtgtctgttcttgtaccagtaccctgcttttctggtgactgtaaccttgtagtatagtttgaagtcttagcttttgggctgagacaatgggggttttctggatataggttcatgtcatctgaatacaaaaataatttgacttcctctcttcctatgtgaataccctttatttctttctcttccctgattgccctggtcagaacttccaatactatgttgaaaaggagtggtgagagatggcatccttatcttgggccagttttcagggggaatgcttctagcttttgcccatttggatgtgggtttataatttatggctcttattattttgaggtatgttccttcgatacctagtttattgagaatttttaacatgaagggatgttgaattttattaaataccttttggttgtctattgagatagtcatgtggtttttgtctttagttctgtttatgtgatgaatcacatgtattgatttgcatgtgttaaactaaccttgcatgctagggatgaagcaaacttgattgtggtggataagctttttgatatgctactggatttggtttgctggtattgagaattgttgcatcagtgttcatcaatgatattagcctgaagtttgcttttctttctttctctctttctttctctctctctctctctctttctttctctctccctctctctctctttctttctttctttctttctttctttctttctttctttctttctttctttctttctttcttctttccttctctctctctctctctctctctctctctctctctctctccctccccctccctccctccctccctccctcccaggttttggcatcagggtgatgctgacctcataatataagtttgggagaaatcccttcttttcaatttttttggaatagtttcagtggaaatgataccagctcttctttgtaccgctagtagaattcagctatgattccatctggacctgggcttttgttggttggtgggatatttattattgcctcaatttcagaacgcattattgatctattcagcaattcatttcctttatggttcagtcttagaggggagaaatgtgttcaataatttatccatttcctctaggttttctagtttatgtgcatagaggtgtttatagtattccctgatggttgtttgtatttctgtagaattattggtgatattcctcttcaaatttttcattgtgtttatttgattcttctctcttttcttccttattagtctaactagaagtctaccttttttatttttatttttttccaaaaaccagctcctggattcatttagttttttggagggtttttcatgtctttatctccttcagttcagctctgatcttggttatttcttgtttgtttgctcttggtttgctagtttttttatttgagatgttaggctgttaagatctttctagctatttgatgtgagcatttagtgctataaatttccctcttaacactgctttagctgcgtcccagagattctgataaattgtctctttgttctcattagtttcaaagaactgcagaggtggcagctggtcttcctcccagaagctctgtcccagggagagatcagagctctatccattgaatcctgggtggaatggctgaagccccctcagggaggtcccacccagtgaggaggatggatcagggtcccacttaaagaagcagactggccacgatctggcaagggttgccacacactttcaaacaaacaaatctcatgagaactcttatcaggagagcagcaagggggaggtccacacccatgattcagtcccctcccaccaggcccttcctccaacactgaagacagaattcaacatgaggatttgggtggggacagagagccaaaccatatcataaaataacagcataaacaaaatgaatttaaaattaaagaatagctgaatagttcgtaattgcaactacagtcatatgctgcataacaacatttcagtcaacaatgaaccacatatatgacagtggtctcataatattattatactatattattttttacttttatttttgcttcagaggtacatgtggtggtttgtcatatagataaattgcatgtcacaggggtttgttgtacagattatttcatcacccaggtaataagcatagtacccaataagtagtttttttaatcctcaccctcctcttaccctccagcctcacatagaccaccgtgtctgttgtccccttctttgagtccgtgtgttctcaatgtttatctcccacttagaagtgagaaaatgtgatattttgtgttattgtgttagtttgcttaggataatggcctccagctccatccatgtttgctgcaaagaacacaatctcttttttcatggctgcatagaattccacagtgtatatgtaccacattttccttatccagtctaccactgatgggcatttaggctgattccatgtgtttgctattgtgaataatgcttcaataaaacatacatgtgcatgtgtctttagggttgagggatttatattcttcttggtatacccaataattgttattgctgggtcgaatggtaattctggttttcgttgtttgggaaatcaccaaactgctttccacggtggctgaactaatttacactaatatcagcagtgcaataaacgttcccttttctgtgcaaccttgccagcatctgtgattttttgacttcttaataatagccattctcactggtgtcaaatggtatcttattgtggttttgatctgcacttctctaatgattattgatgttcagcattttttcatatgaatgttttctgtatgtatgtctttttctggaaagggttcatgtcctttgcccactttttaatggtgatgtttggtttttgcttgtaaatttaagttccttgtagattccagatattagacccttgtcagatggaaagtttgcaaaatttttctcccattctgcaggttgtctgtttactctgttgatagtttcttttgttgtgtagaagttctttagtttaattaggtcccagttttcaatttttgtttttgtttcaattgtttttggtgtctttgttatgaagtctttgcagtttcaatgtccagagtggcattacctgggttatcttcttaggtttttatagttgttggttttagatttaagtctttaatccacctcgggttaatttttgtatatggtgtaaggaaggggtccaatgaataggcagtccttttcccattgcttgtttttgttgatttcattgaagaacagatggttgtaggtgtgcagccttatttctcgactctctattcttttccattggtttatgtgtctgttttttgtaccatgctgttttggttactatatccttgtagtatagtttgcagtcaggcaatgggatggttccagcttttttctttttgcttaggattaccttggctattctggctcttttagtggctccaactgaatttttaaatagtctttttcttattcagtgaagaatgttattggtagttttttgggaatagcattgaattaaaaagtgctttaggcattatggccattctgtcaatattgattcttccatgagcatagaatatttttccattttttgtgtgttatctctgagttacttgagcaatattttgtaattctcagtttagcagtgtttcacctccttgcttagctgtattcctaggtatcttatttctttttgacaattatgaatgggactgtgttcttcatttggccttagcttaaatgttgttggtgtgtaggaacactagtgatatttatacattgattttggatgctgaaactttgctgaggttgtgtatcagatcaatgagcttttgggcagagactatggccaaagtatagaacctcatcgtctgcaaacagggataatttgacttcctctcttcctatttggattgcctttatttctctttcctgattgctttggctaggatttctagtactatgttcaatgagatttgtaagagagggcccccttgtcttatgccagttttcaagcacaatgcttctggcttttgcacattcagtataatgttggctgtggactttttaaagatggttctaattactttgaaatatgttccttcagtgcctagtttgtcgaggatttttaacatgaaagggtgttgaattttataggatgccttttctatatctactgaaatgatcatgtggtttttgattttttgttctgtttatgtggtgaatcacatttattgacttgtgtatgttgaatcaacctcgcaaccctgggatagaagctccttgatcatggtggattagctttttgatgtgctgctggattgggtttgctggtattctgttgactatttttgcatctatgttcattagggacattggcctgaagttttcttttttggttgttgtgtgtctgccaggttttggtatcaggacaatgcttccctcatagaatgagttaggaaggagccgctcctcaatttttgggagtggtttcataggaatgataccagcttttccttctatatctgttagtattcaggtgtgaatctgtctggtcctgggctttttctggttggtgggctttttgttcctaatttaatttcggaactcattattggtctgttcaatgattccatttcttcctggttcaaacttggaaagttgtaagtttctagcaatttatccattgcttctaggttttctagcttgtgtgcataggggtgttcattatgaatagtctctaagggttttctctatttctgtggggtcaatggtaacatcccctttgtcattttttattgtgtttatttgagtcttctctctttttttctttattattctaggtagtggtctatctttattattaattatttcaaagaaacagctcctagattcattgaccttttctgtgcttttttgcatctcattttccttcagttcagctccgattttggttatttcctgtcttctagctttggggttagtttgctattgtttctcgttccttgtgatgttcgttttgtaattagagatccttctaactttttgatatgggtgtttcgtgccataagcttgcctcttaacgctgctttgtgtgtgtcccagagattctggtatgttacatctttttaaattttcattagtttcaaataatttcttgatttctgccttaattttattgtttacccagaggtcattcaggagcagtttgtttgatttccattttaatgtatggttttgagcaatttgcttaacattgatttctatttttattgcactgtggtccaagagtgttgttggtataattttgtgggttttaaaaaaattttctaaagattgttttatgcccaactctctatatcatatttttattgtacctttcgatatgtttggatacacaaatacttaccattgtgcctacactattcagtatagtcacatgctgtacaggtttgtagctaggagcaataagctgtaccacataggttggccgtatagtagtctgtaccatctaggtttgtgtaagtacactccacggcgttcgtacaaggacaaaattgtctaaggatgaatttctcagaatgtgtcccagttgttaagttatacatgacttgtagtgattcctaataaactggagacagtggtagaaaaaaagtattttattttattgtatgtccttttgtattctttaaatttgctttgatgtacttatgtttctttttttaaatgtgcattttttaaacaagtggaagagaagatggaaagaaagaacttcatttcttgagcatagtttgtttttcccaggcctatcaaaataacacaatcttactgcaagaagaggcacaccctggaataatatcaggatgctggcaaatgctcttccaatttttctcagaatgagaaaatgtaaattttaaagtttaaatctttttaacatatgtaatcttatgagtaagaaggttgagtatagaaaaattcttcaaatttccctgagcgtttagaaaagatagtggttactgctgatatttaccattatagagcacttattttattcagatattatatcatttaattctcaaaaccaggactggctacataatttgtgggcccagtgcaaactgaaaacaagggcttcctgttcaagacctaagaatttcaagacagtggaagcagagcttgaaaacaagcatggaagcctcctgagcaggggccctgggcaactgcataaattaccagcccatgaagctgtccttgcttgtaacacacctgtgaagaaatgtgttactcttactttaaagatgaagaaaataatgcatagatttgagataagaaccaaccagccccaaatgtcacagtgtataaactatggatctggtgtttaataattgtggagactggctccaatgcctctacttataaccactctaagaggaatcagctcccaaatgtaaagacaagtatttctaaactatttcccatttttactagggaaattaacttgcagttaaaatgaatagtattttaaaaagaaatgtattttcttttcatgatatcattttagagtcttaaatagactcataatcaaaatgaagaaaggtgactgggtaaaagtatagttagctagatacaaagattgttgaatataggtcaaactatattctattctagttttgactctgccatattaaacattttagtgaaggcactacgttattcttatcatgcttgaagttttcctcattctaatgcattgagtgacaggagtatgattccatagatcttaatatataaatagaaatgatagatttaaaacaaacagtttggcaaaactttcaaaatttttctttgcttacaaatgcaacattttgcagataatatcttatagaagaactttggaaactaaaggaatacagaaatatacactgtgcaacagaaattttctctactttctctgtcaaaaatcaaccaatgtttatgtctagcattgtttactcaatagtgtaaagcaaacgttttccaatgacattaaaatatttgaaatataatactccatccacattcatataccataatgtacttaaaccatcatctatgacatgaggttgtttccaaaagttactgttagaaagaccctataaacaaggataaatattatatctagccttcagcatcaaattaaatctaaatgttaaaatgctagctgagagaaatctgttttcataacatttaaagagaaaattacttgattactgtatgtttggtgtatgtaattattttgcatactggtatttttcacgtggcattcatcttcacaattatttgtgtgattatcatcgtccctattttgccgtaaggttcctaaatatggagtttctattttactcatttctgaatgtcctatagtgaatatatattcaataaacattagaattttatagaaaccttgtggttcagctgctgaataacttacacagttttagaattctttgattgactatggtgtccaaagccaagaaacattggttttggatgacgaatcaagttatatctacttctagcaaataactggcattatagagtttgaaaatgatatttatcagggtcatgattattagatttcaaatcttagaatatcaggtagaaatgatattcaatttactctgctttcattcagaactcaaaacaagttttaacaagaggaagtcttaatcaggcaggattcctctggttgttaagaacatctttcccaatggggaaagtttgcttgcatgctaagaaaggagctttctgtttcagggagtagtgagctctgtaataatcaggaggtcatgttaaatggccttcgtagtccctctcctgtctatatttcctaatgattctaacacataattaagtgtcaataatagttatagtcaataactataagccataaggaaatttagtacatgactgattgttttttattctgattgtatgaagtaggttttgagagtgattattaatttgttatatgtaatgagttctaccctatatttacagggtgaatgcacagttttcttatttctccatcccgaaggaaatgaagtagtatttttcaattacagtgtagtagtgattattatatagaacaattacagactcatgtcttactactcttttattaaaaatgattcatttttctttcttaaaaggttgagtatatttttaaatgccgcttcacagtatatcatgttgtcatttccctttaccctccatgggcacatgtatccaattttataagtagataccacgaaaatattaatattacagaaattaatttaagagtcaaatttttagtagcacaaatgttctatgagattggatataactgcatgaattagcttggtattttcagaatctctgcattctggtctgtatgtttaaaattaggtattttcttaatctgcaaaatattatcttctagcctccactgtatgcaaagaaagtgtgctcatggttaaaaaaatattcaaataaaaaaataaattatcttgggatcctactaaaaactgcattttctttgcaaagcaagttttctcatggttaaaaaatattcaaattacaaagtaaatgctcttggaatcctactaaaaactacattttctttttgactagaaataaaactaattttatcacgtaatggtcattttgtgttgggtgcaatgtttgagtttatattttaagctttttttagagctatgttgctttctgctttcatcttgacataacttgtcaacagacttataattaaagttgtttgaggttcagtgattcattctaaataatgaatctatggagatcctagagaagataaaacctgtgcttggcaaatgtagaaactgtaattcttagtatccttttagcctaccaaaatggaaatccttcagtccctcacataggtaaagatatgtctttaacaaaaggtagcctttttaagctatgtatgtcaaagcaatttttacttaagacatcatggaaaagattttattccttcactgttcattgccaatttggaagctgaaataagaagatcctgaggcttttcccatttcctcacatgaaaggaatcagtcctcgtgtatgaggcagggagattactacaaacccttcccttacctcttggcaaattcaggaaaattgctaaaatgaatcttgacccagccagatccctgctcctttgcttgtaaccagaggcagtttcaatgcaggcctcttgtgacttccttggaaacagaccttgcatataagttggattgccagaaggataatgattaccatcccaagaggtaacgttacaatcgtcatgagaggagctctgtgagacggagaatatgataaggaatgattgtctcaccattatatgacttgtctatctcgtaatgcccatgtattgaggtgatggcctctcatgtcttggctcacaaaatgtattattccaaagatggatgaactgttgcccccggcccgctgccaaaagtatgaacaggaggtaattgagattctaaaccaagaagtgtctccagtgatgaatatgggaactcaaatatttgaacataatcactaatttaaatcaaacaagagtagtgtgttttttagcatttgaataacattcaacataaagatatatatggactaatacatactttatgttaaccttttattgtaattttaaaagctgtttcacttatttgattaaagagtcgttcattaccaagttgaaataattttatttaaaaatgtataacataaaataatcaatgtgtatgataaccaaaaatgcattctacaaactattaataagcatttaaaatgttctaggcaatggaattggtactgatgtacgttagtaacattcatattaatgtaaacattttaaacagcatgtagaattaactatcagaatgaattatactctacatttttctcctctgcccccaccccttatttcctacagtttgaccaatatattgaaggggcgctaaattgactttcgatgttgagattactttcccttgctatttcagtgaaccaaacttaagtcagataaaacaattttatttggcttcaatatggtgctattttgatctgaaggtcaatctaccaacaagcaagaacagtttctcattattttcctttgccactccaagcagtctttactgaagtctttctagcaatgtctgacctctgtttcaatacttctcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggtgagagcatcttaagcttttatctgcaaatgaagtggagaaaactcatttacagcagttttgttggtggtgttttcacttcagcaatatttccagaatcctcgggtacctgtaatgtcagttaatgtagtgagaaaaattatgaagtacattttaaaactttcacaagaaatcactatcgcaacagaaagtaaatgcttaatggaaatggtgttttctggggtgaaagaagaaactatagaaactataggtgataaactactgtggtagcattttaatcctaaaagtttctttctttcttttttttttttcttccttataaagggcctgcttgttgagtccctagttttgcattaaatgtcttttttttccagtaacggaaagtgcattttcatgaagaagtacacctataatagatgggatccatcctggtagtttacgagaacatgatgtctcagtctgcgcatcctaaatcaggagtaattacagaacacatttcctgttctttgatatttataaagtcttatcttgaaggtgttagaatttttaactgatctttttgtgactattcagaattatgcattttagataagttaggtattatgtaaatcagtggatatattaaaatgatggcaataaaattttatgagtgcaaagctggcataaaaattattttaaaaggtacaatttccctttcattccagttattgtaattctaagattaagaaagaacgttaaaatctgccgtatgtttttaagcagcatatgtttagaaactcatggaacacttgacattagaatttgtgtataccagggtagagaagtttgaaaagaacacacatctaaaaataccatgtcagatgttctaagaaaaaaaataaatctagagaagttattcaaatatattatttgggatgtttagtacttctctattaactaatgacttatgacctactttgataattccaaagtaaatcactgggccttttctccctggttgtgtcagcttggctaagcaaatccactagtccaggggtcaccaaactaagacctgctaaccaaatttagcatgctgccagtttggtatggctcatcagccaagaagtgtttttacgttttcaaatggttgaaaataatcaaaagaaaaataatattttatgacatgtcaaaattacataaaattcaaatttcagtgttataaataatgttttagtggaacacagccaaactcatttatttatcacttatgattactttcgcattacaacggcagagtttgaatagttgtaacacaaactgtatagtccacaaagcctaaaatatttattacctatcctatcacagaaaaagtttggcgacccttgctccagtcaaatggctctcaaactctatgaatattagcattctttttgtggcaacaactttcaggaacttccaagcactctactcacgatggtaatagaaaatctaacaaaaattgatggagtgaaaagcataatggcacaaatccgtgaagcttttgatgaatttcttttattattcctagtaagatgtacattaacttgtttgttgtcacattaaacatgtgtttatagacaacgcttagtggacatacagatttatggatactttgcaacattccaacaaccctccaacagttctccaaacagagtaatagggacacctagttgcctaacacttttaatgtcttcaggacttgcctaatacagaaattaacagagcaagctgattcatgtcaatctctgtcttcaaaagcttattattggctcctgtttggagaatggattgtgttggaaaaaaaaaaaaagtgtgttctgacttctttttgttttcaggaaagagtggctagtggtgaaataccttctctccaaaatttgtttgtatcataagttttcggcaatttttgtatgtgcctaaatgagaagtcccattgggcacatacagaaagattcttcaaataaaagctaacataaattgaggatttattatgtgctcagtagtagattcagtgctttattggcatcgcatgtatttttcccagtaacctcccaaaataggtatggctataattactttataaaattatacacagctacagtgtacctcagacaggatttgaactgaggtagctacaaaacctgggctgtatagtaaaatgtctttttcatagatatatgactaaggtaatcctattgatttacctgaagccatcccagttacacctgttgtcccagcataattatatatagcatcaactttcactctcaagtgtgtcctgatttggacggcaaaattatctgaacacgctatatacgacacttgattgataaatttagactgaacgaagatagcaaaaaggcaaacatttaggaacaaattcattaattgataattgtctacagggtggaatcttgttaaagtattgtaatgattaaagaggcatcatgcaaatataaccataagctttatattagctagtgccccgtttttgtatcatctgaagcccactaatatttcactgaatattgaggtcttgaccatctgttgaatagtgttttatttaaatgatgtcctcttccagcttctgtgacacactaccagttgtcacccacgactctttacctgacttgttttattccttctgccttattcctatgggagtatcacacagatccatctctttgcctttctgacttcttttattttgagacagtgtcttgctctgtcacccaggctggagtgcagtggcgggatctcagcttactgcaacctccgcctcctggtttcaagcaattctctgcctcaacctcccgagtagctggaattacaggcaccctccaccacatccggctaattttttttgtattttttagtagagacagggtttcaccatcttggccaggctggtcttgagctcctgacctcgtgatccacccacttcagcctcccaaagtgctgggattacaggcatgagccaccatgcccggccttttgacttctttatctggattatctcctctcattgattcgagcctggctctaagtgactgactcccaaatcatgtagctccagatgtgacactctccctcaaattaaagctttatatctctaaagctatttccgcttgtgcatccagcaactgcctcaatgttcatcaaatgcaaacatttgttccttccaattaaccatacctacttatacattgcacacatattttagttataattcattgcctgtgtgtctagagaagtagcaaatatggaaaaaatcattgcttttggaatcagaattactgaggtttgaatgctgccctttttttttttcccaacttttagtttaggttcaaggggttaacgtgtaggtttgttacatgggtaaattgcgtgttgtggctgtttggtgtacagataattttgtctctcaggtaatcagcataatatctgataggtagttttcccatcctcacctgcctcccaccttccactctcaaataggccccagtgtctattattcccttctttgtgtccatgtgtactcagtgtttatctctcacttataggtaagaacctgtggtatttgtgaaacctgcctgttttaattactagcttatgagcgcaggcaaattacttgttatctgtgcctcagattccagtattctcactttataaaacaactgtcatgaggattaaataagcatttaatacattgcctttaaggtggtaaacattcaataaatgcagtggttcgattcttatttggtggtggagaccatagagatgatgaagatggaggaagattgtggtgggtaggaggagtagaagtgatggtgggagaggtaacgatagtagagatgatgatgatggtggtggaggtagtgatggagatggtagtcatctattatcgacagggaaaaattccataataaacattatctcaaacctaagaaatgtaaaattaccttcctgttttcctcttcaaaacagaatttaccacctgacatctctagttctgtgaatttttcttctactttcttttccttatttattataattagattgtattattgggcaagtgccatcatttccgtcatttcatgttcattcgaattgccaagtccataacctgagccatatacctcactgtggagagaactgccctcctttctaattgatttactaaaatgaatatatctaaaatgatgctttttgatgtctctccagacatgcgaattcccataaatccagatacctccaaaataaaacccaagtgcttcctatggcattcagtattattctcattctccactaattttatgtctaccttcccaataatcattattccacttcagccagtaaattacattacattcgttttgttgtatgccttcatgccactcacataaaatttctcattgcccgtcaaaacaaaggaagcctattattacacttctttatgttttacttagattccattgtagcaaataccgtggatacaataagtaaccaataaatgtttgttgagagagtgaatggtatataattcaaataattgcagtaactaaaatttgacatttcaatatcatttaaaaattctacctagctcttcctggaattgttcttaataataaacgtgaccatcctgatgatctttaataattccaattttacccattagggtatccttatttacccaaaacaattaagggatttaaaattcagctttctaccacatagtttcttaactatctaaggtacatttagtcgattcctaaataattatacagtttctacatatgttgtatttattgcataaatttttctctttacactgagatttgcaaaagtgtctgatgatcttgggtcacaagataattatttctaatagcaaattattcctgcaattcagtgatattattgtacacgtaggtaattatcagagtaaggaactcagcctagggtaaaactagatctattatctagttaattggtatttatccaggagattacttcctaatcatgtagcagttattttaagggatttttaaaaaaagctttaatttatacttttgtagcaaccaggcagaatgaatggcaaattgtttttaagtgaatgccatcttaataaagataatttcccccaagtaaagcgttcataaatgaatatctttgtcctcaaggataatgtagaggcattttgaaatgcctcagttcacctggtctgttttttccctccagggtaagcagacagaatgtaagcttgctttctcggctatttcctgcatcctaactacataggaggataaattgactgatctacatacctgaattattattatatattctacttttcagtttgtttctgttttttgtttgtttgattttctttttatggctgctgtccagatgaagttaaattgtgtcacatctctggaaagaaaatagataacagataagaccgctctgcagttttgtgagactcatgcctaaaacatttttgttttagatattgattataacttcagtttctaaactaaaatctgaaagttgtatggcaaaatataccaagttatttgaaggacctaattagataattaatgtgtccgtgaactttttttttttaatgttctatatgataaattgatcctaaaatatctgggatgttaaactcagtaatgacacttttgcctattggcacagcccatagaaacaaaacattttagatgatttgcttctttttttcctaaggagactagacttatgcatgtttacaggttaattgaggtccagaaaggttaaataacttgctttcagttgcaaaataaggactggtgctgactctcctaaatccattctagtgttatagttgcaatgtcatgttactttttatgtattaaaggaaaatgaccttggtcataaattcaaatttcgctttagacactattttttgttaaaaaaaaaaaaaaaagaaatagaaatcttgcataccatcttcacatcctcaaaaagataaccatctattaaatgttcttgagattatgttgtcttatgcatcaagaataaatcaatagcagtgttttgaagaatatagtaatgtgaattctagagaatgctatgggatcagagaatacttagaacagtaatattcaaactgcagtgcatgaaacagtatcatcacctgggaccttctttgaaatgcagatttggagggcccttcccaaacctgctgaatcagaaacactgctggtgggcccaaaaatattttacaagcactctcggtgatacttatacaccataaaatttgagaaccctcgcactggcatgacaacagtggttctcatgcttcagcatgcgtcggagtcaccagagtttctaattctaataggcgtggagtggtgcccaagaattttaatttctaacaaggtcccacgtgattctgctgctactgatttagggcccacactttggaaatcagttcactggagtgtcttgtcatttacagtctgacccctgattctctttccttatgacagcccccataaaggggctttcacgtatgtccgtgtgaagagaccaccaaacaggctttgtgtgagcaacaaggctgtctatttcacctgggtgcaggcaggctgagtctgaaaagagagtcacggaagggagataggggtggggccgttttataggatttgggtgggtagtggaaaattacagtcaaaggggatttttctcttgtgggcaggggcgggggtcacaaggtgctcagtgggggaggttttgagccaggagaaggaatttcacaaggttaatcgctcggttaaggtggggcaaaaacaaatcacaatggtggaatgtcatcagttaaggcagcaaccgggcattttcacttcttttgtgattcttcagttgcttcaggccatctggacgtaaaggtgcaggtcataggggaaaggatggcttagcttgggctcagaggcctgacaggggccatctattcctgggcaggttaagggatgctactgttgcatcttgtgacaccttactgctttatgatgaaatgatctatccatatgcttgtttcatccactagaattaaagcttccctgggccaggatccatttcttgttcgttacctgtgtgatgtcttctgtgtagtagatgctcaattcaagctgtgaatagaaatgcactatattgagaactggtcctatgagatactatatctttggatgtctggctacagtagctatgtgaaaatgtattcttccagaatgcaaggcgtaaaagaatatcaacacgaaagaagacaggatcacattcccagagctgttacatataattttgttcgttttttgagtgaagaaaatggtactcatacttattcatctaaaaggagaagcatagttgagtgcaaataaaagtcagtttttaatcagaagacctgaactatctgtattcccttacggactcctgattctttcctttaccctctcatactctacatcgagcactgaaactgctctcagcaaggtcgccagagagctccttaattgccagctccaaaggtcactcttcagttcttttccctttttgacctttgtcttgtgcttgacagaaatgattagtcccttcttgaaatttttctctcctgcagtttctgggacattgttctctcctgttttctttcagagtatatcttccctgtcttctattcctgccctttaatgtcagtctacataagactcaaattgtgattttattttcttcttatgatgctttattttttggggaaatatcatttataatctttatcatcacctatatttttgattcacaaattgatatttctacctctccctctctcctgatgttcatccctgtataattcaaatgcttataggctatgtattcctggatttctgactggaatctaaaatatagttttggagtttagatcgtataactctagagagggtcattcacatcatagtctctaagaatggtacatcctgaacttgtgcagtgagcaacctgtgcagccattcacagtggtcttgatatctgccacatcactaaatccctccaaatgtacctgttaaattctctttagtttgttatttttttctacatccttgctgccttcactctagttaaaactgaaatttttctgtatgaaatttttaactgatttctctgcctctgatctcacctctcttatccatgctttttacagcctcccgagggatatcttaaaatgcagttttaattagattattcccctgcccataaatcttgaaatgcatggcgtagaaattcttttgtgatctttagctgcctacctctccagcttcactcccttctcctctgctccttttttaaaaaaaataccagtgctactccaaataatctgcaaactttttagtaccagtccacaattgagataagaagcttgagccagaatataaatcaatgtactccttcctttgtcaagaaagttcggcaattaaaagcaaaataagatcaaatcgtttgttcagtgactcagttgatttatactctggtgaaaactcttttcttcttacagactaatagcaaacagttcactgtctgctaaagtctgaactttgttccgcactgccctatgctttagcttaaattaaccactctttgatctccaaatgctctgtgctttcttaagcttctgtttctttgtacctactgttttctctgcctaagattctctttagatacctttctttttcccattcccatgttacctgccaccgtgctactaaccaccttgtctttctggttatctaaccttgcagaggcagttctcagccatttgtgtgttttttttttttttttttttttttggagacggagtctcactctgttgccagtctggagtgcagtggcgcgatctcagcttactgcatcctctgccccgtgggttcaagcgattgtcctgcctcagcctcccaagtagctggcactacaggcaagggccaccatgcccagctaatttttgtatttttagtagagatggggtttcaccgtgttggctaggatgggcttgatctgttgacctcatgatccgactgctaaggcctcccaaagtactgggattagaggcatgagccacagtgccaggccacttctcagcctttttaacacttctattaaaacacttgccaaattgtatggtaatgactttatttttgcatgcctgtatctccagtaaacgccttgagggaagaaatcatttcttgtcatctgtacacctataatgcataaagcagaagtcagctcatagtaggtattgaataaatatttattggatgttgatgagggattttccaggttttgtgcgagtcttgtcagaaaaacaaaatcactgtgatttaaagagaggaaacgtaatataaggaattggctaagcaggtagtagaaaactgagacgcagcgcaggggatggagaggcaactcaaagcactagtaacgtaaggaagctgctaatatccctagagctggagaaacaatacagaaaaagtgatattaccagagctcagaagctggggctttctaacagagattaaactaaagttaggactgccaggcagaaaattggattgttgaagagggagctagctatccagagaaaacagaagccacagcagagatacatctgctctagaaatgccacccaaggtagttggagaagaaaaaagaccttggcttttctcttcctcccaccttccaatattctgccattgcctccaaatgaacaattaggagggcaagtggtgttgggaaatgtatatccctctaatacagaaagtacagaagaaatgtggggaatagatctgagagcagatgggcatattactgcacagatgggttctggccgtgcatcttctgctcataaactatgtgacttaagccacttaatctccccaagaatctatttcgtcacccctgaaatggaatgtatatggccttccctgtttgccctcacactgtggaaattatattacatgtgtttgtcttgaagaacgtttacatttaaaaaacaatgtctcctttccccaggagaaagttgagtttccaattattaattcagggatggtatcttcccatgaccacatttatatattattcttattctgacatcttctgagagtattcttagtaaagtcttccctggtcagaaacctgtctctttacaaatgaacacatattatgctaccacagagatataaaaatgatgccaggctgggatggcctgaattgtgtcctccctaaattcttatattgaagctctaatctccaatgtgatggaatttggaaatggagactttggaagataatttgatttagatgaggtcatgaagatagggctcttctgaggagattagggcccttataagaagacacaacaaagagcttgctggctctttctccctgccttgggaggacacagcaagaaggaggttgtcttaggctgttcttgcactgttataaagaaatacctgcaactgagtgacttacatgaaaattgatttaactggctcacggttctgcaagctgtagaggaagcatggtggcgtctgcttctggggaggtctcaggaagctttcaatcatgatggaaggcaaaggggaaacagtcacatcacatggaagaatgggacaaggagagtgagacagtgcagggggaggtggcacacatttgtaagtgagttctctcaggagaactcactatcgcaaagacagcactaagccgtgagggatccgctcccatgatccaaacacctgccaccaggccccatttccagcactggagtttacaattcagcataagatttgggaagggacgaatatccaaactataccagaggctgtctacaagccaggaagaaggctgtcaccaggaactgatcctgctggtaccttaattttggaattgtagcctatagaactgcgagaaataagtggctgttggttaagccacccagtctatggtattttgttatgtaagtgctagctgactaaaaaccggctttgttaagcaatgagtattacttctgttttgactaaagttcatagtgatgcttactaacacagtagatggattgaaacaggtcatgatgctggcagtggggcattaagtacacgtcagattgaaatggctttccacattgcactagatccttttggaacccgggttggaagttatttaaacttgaaagacccacaagcatgttgacttctcttaaactcaaggacctttcacactgagagagtttaaagtttaaattgcctcccacagggtccaagtcatcatccaatgcatggtgggtttctttgaacacttctgtagtcattatgagtccacatcatttcaagaaagaagagacagcaacattagttttcatgctaattttcctattcactcaactaatatctaatggattgctatggtatgtaaaacactccagttactttaactgtaaatctaagctttccctcaggaagcttgcacccagcataaactgtcatgaagaagtactaataaaatgttagaaaagttttaaggaagaaaagttcacttcctgcttgagaggcatggaagacttatgggaaaattagcatctgactggataattaaagagtagggaagcattgggctcaagatgaggaaagtgacaattcattgcaggggaaagcctgtatgcgaacaaaacttacatgggattaagtattcttgtttgcctccagcagaagtatgaagtaaaggaagtttagaagtaaggaatgaggttgaaaaggtaggttgagttcataataactaaaggtattcaataaaagattaaggcatgtagacttaaaccttctggtcatggggagccattgcatatttttgagagagagaaatatgatatggctactgtgaaccatatcattttgatctcacttgagagttgggagagagaggccatcttaccttggtttcatagactgggaagggggaaagaaaagttttctctaaagggccagagagtaaatattttaggttttgtgtatcataaaatttattttaaaactactcaactctgctgctatagctagaaagcagccataaacaatgtataaatgaatgagcatgactgagttccagtaaaattttatttaccaaattagatggcagaccatatttgtcccatagaacatactttggggattccggcactaatgggtaaaatgagactattttgctgttgatttttgtttatatgtttcattgtctttgttatagctgtgtttgcagtttttattcttgttattccaattgtggcttttactttatcagtcattaagaagacactaaaacaaatatgactactctcacacgtgagaaagtgagaaatggcatagggcttaaagccagttaaaaaaggatcatggaagatattaataacaatagctaatatgtatatggcttctaccaagtatttgctacatattaatgtatttcacacttaaaatagcattacgaagtaagttttattattgtcactctttgccaatgataacaatgtgtcatagaaatttcaagtgacttgctcatggtcacatagtttacaggaagcatcgcagctaggatttgaacccagacagcctagcttagggtgttgccttcggaaattcctcgccttgctatgttgtaataagttaaaggtgatttcatcaaattatttagctgaaataaaatgcttgactgggactccttaagaatttgccaaagtctatggaagctgcacttattctagattatgtctgttctacattctgaagtatcattgactctagtgtcccatggcaacacttgattatctttaaatacagagacctttttcactgaaaagatttctttaaaatttagatgtctttttcagcatcaaaaataagtggaatttccatataattgaacttttttttccaagtgcaagacttttggagctcaccatggtcttaaccacattatataataagtagtaacttttttcatctatgcttaatattttctctgatgtgagaaattgtatcatcagattagaaagttgaggattttaggaaattaagggaaattccaaggtaataataaattgggaaataaattattttatattgccattagggtacaaagtatacaactaaggatcatattttaatgaaaaatttcagaattaatatcctgatattagagacttcaatcaaattctcatataatccaagatagcgtagtcaaaaccactaaattactgtactgtgtagcaatgaacagtaattctatattgacttatccttattttttttttaagatgggtttctcgtttatttggaacaaaagaaaaatgtagtgttgtagaaatctttggattcagacagacctgttcttgagtcttgactcagtgcttcactgtgtattgaaactaaatgaagatcttcaacttttctattcatgatcaatctgcaaaaataaaagctattacagataacatacaaggtttcttgagcgattaagttttctttttgaaagcctgtgacctgattaagatgcttaaaatgatatatatgtctcttttctgttctttaaatttgaatgaaagtttggcattttaaaaaactttaggtgatttaggagtataattttaagcagatttttagagtacgagtgtccacatatttaactaaacattcaaaaattagttaaaatcaatgaacttgggaaggaaaactacttgctacataatccagaaaattttactaaattatttgaactaagcatgactctccaaactgtggacatattttctcaagggattctatgtattatggcttcaaggtacttttgtgtgtacctcaaaatggctgaaggcattttaacagtgcatctgagagtgtcttacttacatattatttgtacactattttatctatatctttggacattttatatttctgtgtaagtaaaacttccatgaaaatttcatttgtcaccatattttcgttatgcagataagaaaacgaaagaagccaaattgaagacaagctctgaaagggaatgtgcgccctctagtgacccacatttatttatcataaggacataggcagcttttgggtttcatcattttaaataaactttacatttgattttaaaatatatgactcaggattttcaacttgagtatattatattgtatgatcatagatttattactctgacaggatttcatctatcatttaagagaatatttctattaacctgtgttaaggtgattttcttgcacagaagtgtgtttcaaagggactttcaatttattgaaaatgaaaaataggctttaggcatctgtggcttagcagcattttatttcccatcctctgggtcatgcagtttttgcccacgtgttttcacactccttggctttataactaattcctctaatgtagcagtatctgacattttagaatttgtgggggtttcttaccttttaatttttaaggttgtttctctcaaagatatttaaacaaaacttataaatgtgacatctgttcaatcatgtcacactttagaaataaatattaccaatgaattttgaaatgattaagatttaataccaaattaaggtaggaagattattttaacatcatttctacctaccagacgtcaaaatattttaggtaagttttactttgtgcagagaagcaatattttacagcagttttattctcttcactgcaatcaacgattctatgggtgccaagatgaatatcaataccaaataactcagacatttttggcattaatagcttaaaacattaaatcattcaatttgtatgcaagggcatgtattttaaaaagcagaatttttaaacatactaagtatataattcggtatgccataattgataataaagaagatgtacaattttaaggacaatattttgtgcttggactagaattcagcttttgaggcacatgttaaataggcatattttaggacaaggtaaacgccacagaaattgattttttagtatcttttaaagatgcctttcagtgcaatctgaaatcattaaattttactgtactgaaacatattattttatgagtgatgtgcttaaaattacacatataaaactagaaatacatttgagaccatgcaaatataaggaaaaatagatttttgataggaatgttaatatagcagtttccactaactgaagacagagtcctctgtcatctgtcacattgttccaggtgctgtgtaaaccactgaagagtttataggctttttattataactgggaattataacatctttagattttatttaatttgattgctagatgaatagactaatgtaattggaatatgaaagccacaatataagcaaagctgatctcagtttttgtatcttgggtcaaaacctctttaattagagaggtaagtaaacatatttacaagtaatttttaaaaagcatttgtattgtagacccagaaaatctgagacaggtctcagttaatttagaaagttgattttgcctaatcctaggtactcgggaggctgaggcacgagaattgcttgtccccaggaggcgggggttgcagtgagattgtgccactgcactccagcctgggtgatagaatgagactttgtctcaaaaaaaaaaaaaaaaaaaaaaaaaaaaaaaaaaaaagttgatttttgccaaggtggaattcgcgcgcctgtgacacagcctcaggaagtcctgacgacatgtgcccaaggtggttggggtgcagcttggttttacacattttagggaggcatgagacatcaatcaagtacatttaagaaatacattggtttgacctggcgcggtggctcacacctgtaatcccagcactttgggaggctgagtcgggcggatcacaaggtcaggagatcgagaccatcctggctgaaacagtgaaaccccgtctctatgaaaaatagggaaaaaaaattagccagacgtggcggcaggcgcctgtagtcccagctactcgggaggctgaggcaggagaatggtgtgaacctgggaggcggaggttgcagtgagccaagattgtgtcactgcactccagcttgggcaacagagcgagactccgtctgaaaaaaataaaattaaaaaaaaaaaaaaaaaaaagaaatacattggtttggtccagaaaggcaggacaactgggtgggggtgggggcttccaggctgtaggtaaatttaaacattttctggttgacaattggttgagtttgtctaaagacctgggatcaatagaaaggaatgtttgggttgagataagacattgtggataccaaagttttatcatgtagatgaagcttttagctagcaggcttcagagagaagaggctgtagagtgcttcttatcagacttaaagtctgtgttgatgtaagtgtcagagaggtataatgaggcatgtctgacccccacttcccttcttggcctgaaccagtctttcaggttaaattttaagagccctggctgaggaggaagtccctttggagggggagttagccttttatttttggtttacagtatgtttttacttcaggaccagtttgataacagcttttaaatttttacaatttaaagcaagaagtcgctgaagatcgaagaaattaatttacccaagaaaataccagaaagataaaaattagggattaaaacctgtggtgcctgatttacacacacatatatagctatgttatttttttttcttttttgagactgagtctcgttctgttgcccaggctggaatgtagtggcacaatcttggctcactgcaacttctgcctccctggttcaagcaattctcctgcctcagcctcccgagtagctgggattacaggtgcccaccaccacagctggctaatttttgtatttttagtagagacggggtttcgtcatggtggccaggttggtcctgaactcctgacctcaagtgaactgcccgcctcggcctctcaaagtgctggaattacaggcatgagccgccacgcctggccctcagctcagtatatttttaaatgcacatttactttacatttaaagcaacttaaacatacacacaaacacacacgtatcacacatattacaaaatacaagacaatcatgtggccctatcttccccccttccacagagggagacacacttacactatacaaacgtgtatgtgttgtgtgtgtgtatacaaactatcttgatttggagagggaactatttatctaaatattagcttgttttcttttggttaaataggatttcccctttaataatattctgtaattccaaaaatataataattgccatgtagtcaatgcatctcaaagtcctaaaaatatttttagaactaataggatttatactgaatttcatttgatatttttataagatctatttgatgcaaattgaatttgtattctattactcgatttttttttaaagcaaatgccatgtggaaacaagcagagagggacaagttttcccagaaggaaagttgaaaggggaagagtagagagaggttgatcaagaaaaccttcacagatgatgtgcatcttgaactgagccttggaagatgaatagtaggtcatcttcaaatggttggggatttagggtcaggaaagtgcctgtatagtaatatggaattaaaatgtcttctcacttcggaaaactctgaagaagaaaggtgatttttaaaaatacagcaaagttggaaaatcttacctccaaaattatttcttctttaataccaacaaagaataattatagttttgttcctattaatgttaaaacttgcttcctagctaattaaaatgttcattaagaattggtttcataaattatctggtctaggcctagagccctgggaccctgcaatggttaacgtatttcacaggcatcagcattttcctttcaggtttctaaggatgaggcttataagtttttatgaaattctacatgctaagatgtttaaatatgtaaaatggccattcataaacctagttcactaatcaaattagttaagtctgggagcttggaggacttccactctcaaagtttacacatttgggaatgatgagttgcaacttgtatattgaaagtgactgaattaaaatttatgtaaatgtgtcatcttagtttaataggttatgtggcagtcactgtaaagaaaattaacagaacacagtgcccatcaggaggctcttctgacataattagcacagttatatagcactaattcatgtaatgttttactattgacaattcaaaattgacaacttcttaaatggcaaacatttctctagttctttgagatgtttgtatgtgtttttgcctttgaatttattttaaacatttatatacacaggtatctctcagtatttaccatatgggatgtaattaacctaatttacatcatttttatgggaaattcaactggatgaggctgagtctgtttgtacaatataatactgagaaaaattgtcactctctgaatatttggtatatatgccccaggcttttgatattttgaaacttccaaaaaatggaaggtctttttgaaaaattgtcttggtgtagtaatacacttttgccaagaaaaaaaaaaatcaaagacttacttgccctgtatgatgggactttacaagttttaatttcaggggtttctgatgagtatatttgtaaaggagaaaaaaattgtcgcttcactgctaaccataaataataacaaattgaggttttaagatatacttgaagaatagaggacagaatattcatcaataattatagaaataatcattttgtgaacagagaatgagaagttatttttttattagctaaaggagattttaagctaggtaaagttagactgcatttaagggatagagtctgataacattcggaagtacgttaagtacagagttaagtatatgaggaaagtaagttaagcactaaggaatatattagtggactgattccaaaggtgtagggacacattatgagcaacttatgatacataagttcattagcaatggttttatgtgagttgttaaagtggggaaaaaagaattattagaaacgagtaattttatgaagaagcaaaaatacatgtacagaatccaacgttgaatatggcattgaaaataagtcttcagtgttttccttgagggttttaaagaaggtaactgagttgcatctgaatgatatatttcgttcgtaattaaatacccaggctcacttagtgcaaagtatgatagaaaatgccatctgcaaagcactgggaagagtagatagcacccaatttaaagcatgaagacatttaaatcagaggtgtctgttcatttgccatgcatctcagcaaagatatctgaggaatatctagtagcagtgaaatacatgaaaactacacgacaaaccacaaaaagtgatgaagcgatagttgctaaattgataaggaataaaataaacgtgcaattgcttcttggaagccagggtctgagtaggatccgggaaggagactgagttcattgtgcattgaaaatgtcactgaacctaaaactaagcgttggatgtaggccattggcactcagggagagtacatgggaggccttgaaaccctgcctctgcttcctcttcacccttccatcctcattgctggcataaagagatgaggctatccactggcagaatattggagagaaaacaatgctagtagctgacagttaactcccagaactctaagagatggtggtacatgttaagtattagagtgtaggctgactgcacattatgtgtggacaaaaagagttttagcaaggaaatcagagatgtttgaaggaagaagtccaaatggaagcaacataaaataaatattaagattaggttaggaatagctcagagcttgaattgtgtaagaattgggttcagtgtccacctgtttcccatgaaatcaagatatcacaataatgatagaaatgaaagggaagaactccaacaggtgagaagagtccaaactcattaatatgtttctttgttccattttagaaaagaagtataacattaacctctgtgcttatgaataggttattttccttagacaaaacgctctcctcaccactgccctagtaaaatttgaaattgcctttttaaaaatctgtacatcaaaaaacgagcgtaatcactctccatacgatctttgtataaaagggaagttcacgcactgtatgtgacccctttccaaatttataaagtcagacaaaaaattgaatgaggaaagacctttctgtagaatttcacatcctgttgtttgaattgatttgaattatcagaactacgtgccaactggtgtccaggcctcccttaaaatcttcacagacagagaagcaaacagacagttaccatggtgttgactccacaaagccttctttgtgtggagataaccaatatacttggcagagcctctaggctagaagctgatttaatcctaatttacagagaaggtgttttttgattatcctcttaaaaagaccagtgtgagctgagccccagttctgtgtctaaaccatttttatcttgtcaaacaaatgcttcactaaaccaaattacttgataatgtggactaatgcattctcgtctctgttctttatggagttaatagcatgtctggcacatagtaagcacttagtatatgctttatgaaggggaaaaaaaggagacatttgaccgttttaaaaggaaacatacaattttgcctttttcaggaaaatacacctctaaaagtgttacaagatttcttctggggccgggcgcggtggctcacgcctgtaatcccagcactttgggaggccgaggcgggcggatctagaggtcaggagatcgagaccatcctggctaacacggtgaaaccacatctctactaaaaatacaaaaaaaattagccgggcgtggtggcgggcgcctgtggtcccagctactcgggaggctgaggcaggagaatggcgtgaacctgggaggcggagcttgcagtgagccgagatcgcgccactgcactccaggctgggtgacagagcaagactccgtctcaaaaaaaaaaaaaaaaaagatttcttttggaatgaaaattatttactttcaaactaaaaacaaacaactttgtttcttttttctgcagtgaattggaggtggtggtataacagttacatcaacatgcatgttataggagcagaaaggctgtgatccctttccttcctccttatacaggtcatagcagacattcctataacaaaagataggttaacaagagaaaagcatgagatatttatctaataaaagttttaggtgacatgggagccttcaaaaatgaagacccaatgacccaaaggaaaactgtttttatgcttagagttgataaagagtagacagccatgtaggaatgtgattggacaaaaagggaatgatctgatagtaatagactagggacaaccagccaggcctgtctgtgtagaattccttcctcctacacatggggtaggaccccacttgaatgagggtcttatgatctactatcaaacaaaagtatgtcagagaattttttatggctagctaatagagagaaaggtgggcaaaatacagagttataattctggcttttatggttggctttggaggagagggtttttggtttctatgacctaccttgaagaagaagaattctggttactatgactcacttcagggaagaatgtggagttaaagacaggaggggaggagaaggtcagagggaccttggttttgaggctgcttttgaggccttccagtgttctttagttcaaagtttcagcatgccaaagtgccatactttggggtatcgttttctgagcccctacagtgtgcaaacaagagcaatgtcaattcaacgcctagtagaaatctttctccaacataggcttcagcagatttctttcagctgtcatgccagcctagtaccttgaggcacgtttgagtttcagggacctctaagtagaagtgagcaatctttcttagagatagtctaaatcaaatgagggtgagactagagagattaagtttaaagcgtgaatttgaaagtgactggtggatattcctatctcatatttatgagtcagagggtatttgatgtataattgagtcagacaaataaatttcaccaaagtggcccaaatgcattatattaacaacccagttttcaaaatatttatggaagagtcagtgaaggattttattccattggaggaggaacaagaataaagaatagctctgaattactttagaaaatatgaagcgaaatttgtttctacaagtacttgaataaaagacaaagtagaatatacagttaagaggtctatgaaggccagattataaaggatcatgttgaaattttgttctttattctaagaaaaatgagaaagtctttgagtggttttacgaatgaaggtaacataatcagatatgtttttactaccgtatatttcaaagtagctagaagagaataatttgaatgtatctagcatagacaaatatttaagattatggatatcccaagtacactgatgcgatctttacaaattatacggatatgttaaattatcacatgtacccccaatctaagtacatctattatgcgtcaattaaaaaagatagaaatgataatttttccagtagtacataaaagagagagttccataaatactgcccagaggccaagtgaaaagctattgcggtatttttggtcacatttaatggcaacacagatttgggttctggctatggagacaggaagaagcatacatattcaggagacagagaatgtatgtgtgacagattagactttgcaatacattaaacatgggaaggaagagagagggttttagttggtttgctgtaacaaaataccataaactgggtagcttataaaccacagaaatttatgtctcccatttctggagtttgggaagtttaatatcaagtaactagcagatttagtgtcttttaagggcaggcttcctggttcatacttggtgctctctcactgtgccctcacacggtggaaaagaacactgatctcttcagatcattttaaggggactcatttcatgagggctctaccctcttgacctaattacctcccaaatgccccatcttttaatatcatcacattgggaattaggcttcaacatacgaacttttgtggggcacaaaattcagtccatagcggagatgaagataacaaatatgagggatggtgatgctaattactgatctggggaatactgatagagtactagtttgagggagaagatcaaactttaaaccttggcatataatgtttaaggagattttgcagcatgcaagtggagacatccaataggcagatggttatatagctgtggaattcagaacaagtgcctgaattagagatatacatatcagaatcattgataaatagattgcaattcaaggcatgatgactgatgtgttttctggtgagagatagtagagtagaagatgattggtaatgaactaggtcttgacatctagtacataatgatagggtggaggaggatggacctgcaaagaaaaaattaccaatggtcatagaaatagaaggcaaattagaatagagtggcatcatgaagccaaaggaagaaaaattacaaacggatagtatggtcaacagtgttaactgtagtcctagctacttgggaggctgaggcaggggaattccttgaacccgggaggcagaggttgtggtgagaccagattgcaccactgcactccagcctggtgacagagtgagactccgtctcaaaataaacaaatactagaaattggatggactcagatgcttgagcaaaagtaagagaataaagttcaaaatgtaggtagtgggaatgactttaattaaaagaagggaaactcaaatgtaaaagaagggaatgagaacggtggctacatatgcgggtctgatggtgtttggaaataggaagtgaaagaagttctactctgataattgcacttgtttctgtaaggtagggaacaagatcatctgagagagctgcagaaagaggatgggccagagctttgataaaaggttttaatagttcctgtagagacttagagcccaacttgggaaaaaaaaaaaaaaaaaaaagtatggcaggatgctaggttcatttgaggctgttgattattgccttagtttgggttgccccaagagtagatctgaagagaaggatttaggtgcaagcagtttatttggaaagtgatcccaggaaacaaagtagggaagtgaaataagaaaaataaagcagccaataaagtatggcacaaatatagggatcaggttactgctggaaggaactggggctcaatcatgcagggaaccccttgagacactgtgtatcatacttcaggattgtccaactgaggggcaagggagctgggaaattcaccaattccaagctctcactggttaagggacacccctaaagtattaacattccagcactccttctctgtccaatatactggcaaatagatgcttgcagatagagagacacaggaaattttatgttgggccaaagcaaaaataaaaatgttttaagacattatgatgataaatatgcataaaagatgattgaaatataattcactggtttgggtaggtaatcaaataaccatagtaggagagtatttaaggagttaacatcgctgaagagagtgtgaaagatttttacagcatataattgtactgtatattttaatcaacattatgaatgaagaaacaggaacctgatagtcaaacttgtggataaaaaatgtaggaaagataaaaatcatatatgacacaataaaaatccataaacatttgtaatgcatacacagataacttactgacattcagtgacatgggatttagaggaatcaggatccctagtctcttaatttcaagttggatagcctcgataaataacaactcaatctgtatgctatgaaccgtcaagtttctgacccatggtattgaggtcaattaacttaatttctctgaagctccatctcatcctatgggcagctggaattggtgatacctaaccaaagaattttgtgagaatataaaatgcgaatatgtttttctaagggctttgtgttccattaatttctgtatctgtttaatttttaaacaatagcctgcaacaaatgtgagaaattctaactggtttatatgattcaaagtcccaaaactggagttcaatagatcaggtcatatgtttgtgatagtaattaggttgtgatataactggtttaatgatagtttatgtgaaaaaattcctagaagttttaagtcaattgaattgcaatgtgagttgaaagtctaatattgaagtgaaaatatttattgaaatcatgggctatatcaatgaaagtattataaaccagaaagataattattcttccctgtttattttacacactgctgatatgttccctttaagtacccaatttaaggaaactaagataacaacaagccatagaatatccgttgaagtaattaagcatagggtaggctgatgatcaggtatctactgataaatttaaagagcggatttcaaatatttataattttgtatccttttgccaatatctttccaactactctccacccccaccagctcctggaaatgaacattgtcttctgtttcttttagtttgatttttttttttttttttttttagattccacttgtaagtgagatcatgtggtatttgtctttctacacctggcttatttcacttaacataatttcctccgggttcatacatgttgttgcaaatgaaaggctattcatagtcttaaaggcttaatactattccattagacacttgggttgattccatattttggctcttctatacctaaatcaccagattagaatgaataatttatccctggtggctccaaagatctcttccaaaaaaaaaaaaaaaaaaaaaaaaaaaggtttgaaaataacaggataggtgatctgatatttatggcagcataacaactcacaccaaaatgtagtggcttaaaacagcacctatttattatttctcctaattcttcaacgtaggcagtgccctttgggtatttcttttctctatgtggcatcaactggagcactcatttgtctgtcttcagctggcattgagatgggtcacagagggctttatttgcatgcctggtgccccatgcttcttcatgtggcctcttcacatggacagatcaagtttccttaaaacatgatcacctcaaggtcattgtacttcttatataattgttgtcttctcagaatgtgtgctctaaaaagtcaagctctgacatgcaagcacttctcaaaaccttacttgcagtactcttactattgtcccatttgtgatagaaagtcacgtggccaaacccagaggcagtatgattggagactacagaaaagcatgtgtttcaatggtgaccaccaacaggaattttttttttctcataaatactttccaaaaagaaaaggttatcgtgggaagtagtactttttcaaatagtggaaacattcaagcagaggctgggtaatagcttacaggatatattgtagaagtgatttttacattgaggtgaataaaatgacctctgtgatcataagactctagatcaaagctgactccaaatttgagtctacctaacagggaaaatagtgctgctattaatactaatagaggtgtcaggcaggagtctcagattgagaaaagaatgataaatgtggataaattgctttttttaatatagaagaaagagataatcaagaaataatgacttttattttttgctgtcttaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaaactccgtgctttgttatctgtgattctactagttgatagattaatgcgatatgataaaatgctgtttaatatgtcttaaaaatatattttagatagcaagcaaaatcaaagtttagcctagagaaatctttctggattcttctgtgactgactagggatgcctttcataaacttgccttaacttacatattatttaactataaattaacaattttatgacattaattcatgttgattcctttcatatattgttcagttacctcaaggctaggccttagcaagcttgcacaattgtgtagagtagaatagagtaaaatagaatagaataatataatagataccatacttaggactatgtctatattctcactgttatcaaaaagttattctttatagtcatcaatccctgtcatatattataagatatttaaatttcccagatatttgtgtattaccttatctaaaaggtgtccagcctttctcagtatttacatgtggtagcagatgctttgttgttgttattcccttctgagatggtataattttgaccttcacaaataggaagttttattaatttaatataaagtgtttcatctttagggaaattgtcaaggctttaatttttcaacttcaacaattataaaacatgcatctttgtatatgattggcaacagtttgtaaaataatttctaacaggcagagtaaataaaatgggcaagctaaggaagcagtgattatgaatgaaaagtaattttatccatgggaagatcacatctaaatgtgtatattagctctgctttttctctccaggattcaaatcatgaagttcaaaatccattgtatttttacaaatacgacattacctcagttacaagctaatgtttgctgttggggttggaacttttggagatcaacaaaagatatatatatattctggaaaaaaaatctattttttaggctgcttgaaaaagggaagacaattttgtcaccagttcttcttagagttaactacttataaattggaaagctattttaaattacttattagctttataagacatgctgttgtcagcattataatagactattctaaattgtttcaagaaatgggaaatatgaaaactgaaagataatatataattgtagaaaattagctaaatgtcttttttcaagtatacttctttgaaggtaaattgtttgctgtgatttttgagggaaattctcttagtagtagaaaattaattagagaacattaaactctaattttcaaacatcatgttacatatttgaccactgaaagtatgaatcacctttagcattttattagctaattaaaaatgattattgatctgattctcacaggtttctgtctgatactctgtttctttatcttaagacagctttgatcaggcaggaaaattgagtttcagtatttcaggaatataaattttaaaagttcctgttatcatgtggttacctatgaacgatttgcattttatcaatagcgggagcatgacagactaaaagtgctcaaaaatgtacagtgttttataactggttttctgataccttgtgagtcccctttatcaacctgaactctcattttctgaaataacaacatcattcttaattgcctactaaaatgggacatgaaatgatttaccttgatgtttccctcaggctaaatacaatgtatatgtattaaaaatccttgagagaaatacataattacgatgatggatattcagtttaggtatccattaattttcttactacatcacctgtcggtttatataggttattttaaactcatggcaggctcgtgtcatgaacttgagtggtattaatccatttttaggctttcattaaaaatggctaaatattaccaactcttttttttttcacttgatttcttcatttactcctttcaaatgcttttagccagttagcatatcataggccattatcagttcaatttcacatattttaaaaaatgcaacttttaaacctaagcataattttttccttgtatattcaccatgtgttttattcatataattaacaaaatgcacttatttaaaagctgacttctgggggacctttctaatcaaaatgtccctggaccaccaatattgacattatctgggagcttgtcagaaatatagaatctcagaactagtaaatcaaaatttgcctttgaacattttccaggagtgattcctatgcacataaaggctcgagaatcaatattctaggacacaatcttgggctttacgtagcagttacctctcacattcttttagtatcactgcagttcagactttttagctgaattaacagattctaacaactcgaattttttccgtgagcacatggtaacgcaaattggtaatgaaacaaacaaaaaaaatagcctcctttgatcacaaggggatttgataaggtgtctgaaaatctggagcttctgtgaggttctcttgaaaccctccctatcaagtcgttatggtcatctggctttgggctcttcctcggatctgcacttgattaccctctttcagaatcaactttttaccaactcccgctggaaatcatcaagccagttaatgcttccaatttctcctatctctgttatctgtgtttactacccagagtataggtacctcgagtctatattttcttctatctttctctctctgctctattgcactttcttttccttgcttcacttcctctgctttcccacactctcactcggcaggctcaaacactttttcaagacaagccttctatatacttattctactcatacgtggaaaccaattttaccctcgaaaacagcactatgactcatccctcttttgtacccccactactttagaatgactgactccctcacctaacagagacaattccaaagatactgctctcttcatgtaaaaatacctctttccttgcagttaatgacttctggccatctcttatctaccattttatcatattttctcattgaagactttggcactaggttagtagattttttcaaccaatttgttctttcattcttagttatttcagcatccctgtgggctctcctgctatcactaaaagctgttgtttctctcatctcctcaattcagctacctgctgtcatgattgtatgtatgtagatgttgtcattgtcaggcattactccatttctttaataagattatttttttgagacggagtctcgctctgtcccaggcgggagtgcagtggcgcgatctcggctcactgcaagctctgcctcccgggttcacgccgttctcctgcctcagcctcctgagtagctgggactacaggcgcccgccaccacacccggctaagtttttgtatttttagtagagacggggtttcaccgtgttagccaggatggtctcgatctcctgacctcgtgatccgcccgcctcggcctcccaaagtgctgggattacaggcgtgagccaccgcgcccggcactaacaacatattttaacaaaaccagcagttcttcataagctttccgtgcatcctaagtatattttcaacttagtttctctcaacaattatttcaagcttttgtggggtacctaaactttccccatcattcacagtaaatgatttcatctcctactttagtcgaaataatatttctcaaattgtgggtatttgtgctcatagtatcttttttttttttttttttccacctgccttagtggaagaggctatccttcacctggttgaggctcatctctgggtgtgtgttctcagcagcatcactgactatgtattaagccacctggttccattcagctgtatatccagattgtcaaaaatctacatcccaggtctttatcattagcttttaaaccggttgtgttttcatcttttagaacgtgtcctctcctataaacatgcatgtgaatacttaacgtgccttatcttactcaatccctctgtagaactagaacctattaacctcttttccctcatgaaattctttcctcgcttggcttatgggatactgctttctcctgattaattctttcacattcttggccatttgttccaattcagtttttctttaatattgatattcttcagagtccttgtgtttcttctctggatatcctcattcattcccattcaaatagtgtctattttcaaatgaacccttctcccatatgtatctttagctcatctctttcttaaaacccagggtgatatatctgactgcctaatagacaattttaattgatgtttgcctgatatcttaaatctcattatttccccagacctcctttattctttctccttcctttcaccctgcaaacagcctaatccagaaacctgaaagtgaactgggtcacctagatttttcttctaccattcacaagtccaatctttgacaggttcaattaatcctgctcccttaacagctcttgaaaatgtccagttctctctattcccatcaccaaaaccctgattaaagctaatatcatggcttacttctatttaagatgacaatcctgtagctggtcttccctgctactaatgttatattcctttagaagtttccacatcacctctgccaaagcgaacatattaaaacctcagtatgatcttgttatgtctgtgtttataatcatttgagaaagataaaatcagctactgatagccaggagctggcttggcacttcagttaggctttggaactgctagatgttgccttggtacttgcagccagtctgatgttctctggttgaatataaataattgctagggatgccagcatcatacagggacacgctatggttgtgatgaatcaagataaaagcaagaccactttgtaatcatatcttaatacagtaaaaaagaatagcattgtccaaaccacgcctaatgaccaaatatccctcatcttcattaatgtgacacattatgcttctttactaaacacagctttagcctctctgcattcctcctgccatctagataaaaattttaggacactcaacatagaattaccctacttccttacaacatccaatcaaaacaaagccccacttccttgatgccccctatcatgtaacacaagcccacatcttaaaataagctttttctaacatactcttagagacagccccatagttccctgtgatgcgctgtctctctcgttgcagcgtgtaaatcaggttaactttgataacctacaaatatgttccagtggtctttgtctgaagagtgttgacaaagtccatgtcttcatattgccctcttaaagcctacaatgatctaatttttgtttacttgcacaaactaatttctagccattttcatttcaattccattgttggtttctagaaatcaggacttgaacgtgaagtggctttggttttatgtgtgtgtgttttgtttttggtgtccccatgcctaacacacaaaccaataaatgtttaactatatggatatgtgatttttttcagttctgcagttgcatttaagataggatctattaccaatatgaaggatagaacaacttctgaataaacatttgagtgaataagttactcttcagtcaaagggtaaaacttcattatagaatgttaaatgagtagattcttaattacttctaatgtcggagtaggactgatagagatccataacttattttcataatgttagagaagatacagaaagaggaggcttttaagaggtgctaataaagaaggaggaacagaggtctgaaagaggttttaatcaacttattgaggaatttgtgaacttccctgtgttgtattctttgcttcaaattattttacttttcttccttttattgaatattatataacttagttgccttttattttgcatttaggttacccattttagtatttataattcttcatgatctctaagaattttcatgagcccacaataatcactcatttctgatacattgatttactgatgccttttttagcttctgtatactttacttgaaattatgtgtactaaataatttagaatccgagtagtggcttctaaacatgtgatcatatattaagcatatattgagtaaagtatttagtattctatatgttaatagcataatttaaaaactgtatgttatgaaatatagatcctttcaagattaaaaatgtatatgcatgtagacacatatatgataaacagctctatagaaaaacacacatacagaaaagctggatgacttcatgaggacgaaatttaagagaaagataatattgtcaagggcagaggtatttttatgaacatggcaatttcgaggaggtaattgtagtttttatcagtactgaatgttgtaagaagcatttttcctaacaagaagaaaattaatgactttcttttctttttttttttttttttttttttcccgagacggagcctcgctctgtcacccaggctggagtgcagtggcgcaatcttggctcactgcaacttctgtctcccgggttcaagcgattctcctgcctcagcctcccgagtagctgggactacaggcacgtgccaccacgtccagctaattttttgtatttttagtagagacggggtttcaactgttggccaggatggtctccatctcctgaccttgtgatccacctgccttggcctcccaaagtgctgggattacaggcgtgagcccctgcgcccggccaaattaatgactttcacaaaataactttttgtacagtagtgaaggctgaagtctgactgtaggtatttggagtaatattgaaatactggaatttggactaatatggtaatattagtccaaatttcattgaagatgaaatatataaaagaaaatgaagactgtggttgaagagtattcagatgatacccttggtcttgaaaacatgggaaaggggtatatatacagtatgtatgtgtatgtacatatatgtacatacacacacatagagagaggaggtggaagatcagagccatgaaataaaaacagagaggtaagattctaccaagttttgactcatggattgtatatggtactctttcttttctacttaggtattggtttattaccagtatcaggacttgagctgaagaaaagatggatgtgcccaactccctaactaatatgcagtttctagaatactttgatttaatccatccttcctttactgagcttgcagcacctgtccccatgtactggttttatggccactttatataaagctattagagttcgttatgaatttgcactttaagagagcattgtgggtaaggggagagaccataatattgtatatggacgcgttacgctaaaatagagctcgccttattatgtacctataatgtaccagccactttcatggagacttgggatagagtagagaaggatatagataaggatacctgaccttatatagtttacattctagtgggaaagatggaaatgaagcaagactaatatgtaaagcatgtggaatgttagtgataagttccaaggagcagaataaaatgagagggtatgcatgtgcttgtagacagagtggcactaaaaggcctagctgaaaaagtggcatttgatgggggaaaatgtccaagtaagtaatttagggcctttttaggcatggggaaaaataaatgcacagccgtgtaacagcagcatgcctgtagcatcagggaaaaggtaagcgtgtggctgcagcagaaaaatcacgatgtttagcagcagaagaattcagaaaggttaaggaagttaattaagatcagaccatggtaaggacttgagcttttattcagctgtcagcgagttgagctgaatcctgttgtctctgtctgctgtgttgataatatataatcagagaacaaagggtgaaatataaagacctttagtatcctattttgaaacattcatacccctcagagatgatggggtactttgtctaatgtggtagtagtgagcaccatgataactcactttctggctatgttttgaggttagagccaacaggactttgtgatggattgaatgtgaggcttgagagagagaggggagtggaggattctgtttttggcctaaacaaaggaaaacacagattgaggcctaggacactccaaagtgcgagctcagggacatgattaggaacctgcaaaggagatggaggaaaggtgacctctgaagttggaggaaaactgtgttcaagtagtacgtgaagccaaattagcaaatacttctaagaagaaaaaggaatcctctcaatcaaatcatggtgataggtaaagtgagaactgaacatcagtcattgaatgcagtagcttgggggccaatggtgagactgataagagcagttttgatgggactgagtaagagaatagatgtgagagccagtttttgtttttgttttgaaccagtttttactttgcaagatagacctgtggaaggcctatgttcctctttgttgatacacagtcacttaaaatgaggacagttatcttcctttttcagcaaaatatatctctttagactttgtttttggtttttgtgcttttctgtgctttttaatgtatatttctgtgagttaatgggagacggtagaaattttaggaactactgatccaacctacctgaaaacagaagttcatatatttcatttgaggacgaacgtatgggtggccagatcccaggagaaatggcgattttcagtgatgtttatttacttaacctttttttttttttttttttaacactttttatatgtggttatttggacatttccacgaacaaggtactctcatcatctcttgtgtcaaaaatgtttccgtggccaggcacggtggctcacgcctgtaatctcagcactttgggaggtcgaggcgggtggatcatgaagtcaggagatcaagaccatcatggttgacaccatgaagcctcgtctctactaaaaatacaaaaaattagccgggcatggttgcgggcgcctgtagtcccagctactcaggaggctgaggaaggagaatggcgtgaacccgggaggcggagcttgcagtgagccaagattgcgccactgcactccagcctgggcgacagagcgagactccgtctcaaaaagaaaaaaaaaaaaagtttcctaaatttctttttaagattattgaagttacctttaagtagaatgagcacatatttcagtttgtcgggtatagtcttagcttatgtcaaaccatttttctcagcttaattattcctagctccccattttactataaaaactatctcattttgggaaataaatagcgagcttcctttaatcccctcagaagtcccacatggtaggtatctttattgctattttacataggaaatactgaggttcagaaaggtcgaagtactttattagggacagatagtaagcagtagagacagaactgataacagcagagcaaaaagggtgactgcaggcccttttgttgtagtatcttctttaacatctctttgttatactaaattttattatttttaatcaactatctacagctgtgtctgaaatgaaatgttttctgggctcttcactgtctcattcacactcttcaaggcatacttgtatgcatattcctcttcattttgcaatgttcctcttgaaagtaatgtgccctaacagaacccagatatcgtctgaacattgacaaatatgcagataccattgactgcttctttctggggtctatgtgtctctttatgcaccagttattcagtttatttgagctgtatacagagttggtaatcagcctatagactgtcagagaccattctgagtgacccggcattccttgtgatatcttgttggccctgctgaattaatagttaaatatgttgaacatccctaatacatccaaactataagctctgtttgctctgatatatattctgatacgctcacacctttttgaataatatccattgaaatacccctagcaacagcagagcatgtctgaaagaaagctgaaattataagtagaagagcagggttctaatattgaatctaaaacttcctaatatgatgacctttgatatacgatttaatcttactgatgctcagttttctcttgtataaaatggtatacaacaatgctgatttcttctttcttacaattattatgacatacatatggaaattatgtacataaactataatttggtagtataaggaatcttattttcaatgtggctattgcattgttttcaaaattttcacaaacctctctgtgcctcacttccctcctctgtcaaaatgggaaagtaatagtacctactttatagattattgtttttgttgtagttgtggtggttgttactgagactatttatattagaataactggaacaatgtggttaacaagatattaaaggtcaaatatgattcctgagatattcaaatataagttttgttctctgttagtaatattaattgattctagtaagcttagaataaagagattatgatgataacatttagagggctattgataatttattttcaatatttataaagaccacatagtgttctcattctactttttatatcatttcacaaaaactaaagcaaaagctcaatgtagataaaatagaaacccctctgataggagaagataactctaaaagtaactcaaagaacatcactttactcagcttgttgtcattgttcctttatgtgttgtattgtggtatatattttttctttcatctgtatattgttttctggataaagttcaaattctggacaccccaaatcctcctgtctttcttgatatttacattacatatttacttaaatgtgcttattttttctcctctaagatgctcagggtgctttccatataacatttaccttttaatggagaataaatgtaagtagtgaaaaacaagtatgccataagctgctaaggacagataacttagatcacaaaaactaataagttgagaaaatagaaatattggagcttcatctaggatcttacttttaactagatgttgtagctactctattttcatggacttttcagttcaaccaacaaattagaaccatccatgattgtgcacgttcctggaaacaattcaatactgtctttgtgaaactgaatttcaagacaactcagaagttttacctgctaattggaaagggatcctgggaacataaaatcacaaaataccacaaactgggtgctttgaaattttcaagtggaatgtaagatattaaaaagtgtctgtcactttcagagtttcttaactaattagacaaaactgagttttcatttgttgcccttcagagcaccatgtaaaatgtgtatctttcagctaagagataggtatttaagaaaataaaacaaaattactaccttatagattttttttaaattttactcttaatttattctcagttttaattagtattttatatattacagctattcctgatggagtttattctgtgaatgattggcttttttttttttttttagcattttgtactcttgatattgaatccagtattcctaattcatgaaacctttttttgtgattttaatagactccatttttagagtaattataggttcacagcacaattgaacagaaggtacaaaaatttcccatataacccggctcccacagatacatagcctgccccactgtcaacatttcccactagagtggtatatttgtttcaacagatgaacttacattgacacatcattatctcccaaagttcatagtttatacattagctttccctattggtgccacacattctgtgagtttaaacaaatttacaatgacatgtatttatctttagagtgttatgcggtgtaatttcactgccataaaaatcctcaatacttttcccgttcatctacacttctctcctaatctctagaaaccactgattgttttgtagtttacatagttttaccttttccagactatcatatattcggaattggaatctagggtgaaatcctgcggtaaaatatatagccttttcagattatcttctttaacttagtaacatgcatttaagttcttccatgtctttttatggcttgatagctcatttttaagcactgaataatattccattgtctggatgtctcacagtttatttatccattcatctactgaagaacatcttgattgtttccaagtcttggcaaatacaaacaaagctgctgcagcattcatgtgcaggaatttgagtggacatatgactcctttgtgtaaatgcctaagtgcatgattgctggatcatatagtagaatgtttacttttgtaagaaacctccaaactgtcttccaaagtggctgtgccattttgcattgccaccagaaatgaatgagagttcccattgccccatttctctgtcggcttttggttttgtcagtgttcttggattttggccattctaataggtgtgtagtggtatctcattgtttaatttgtaattccctggtaacatatgatgtgaaacatattttcatttgcttatttgccatctgtatacttcctttggtgaggtgtctgttaaggatttttgcccatgttttagtttgtttgtttttgttactgagttttaagagttctttgtgtatttcggataagaattctctaccagatatgtctttcgtaaatattttctttgagcctgtggcttttcttttcgttcttttggcagcatctttcacagagcagaaccttttaacttagtactattcaacttattaattctttctttcatggatcatccctttggtggtgtatctaaaaaactatcaacaaactcaaagtcacctctgttttctccactgctatctgctaggagttttatagttttacattttactctagagtctgtgattgattcattattaattaactttatgaattatatgaacaccacaattactttcaagcagttacacaaatttctaaattcagtggaaatgtatttatttttggtatgtttatttttcatttttattttattttttataatttcaacttttggattcaagagtaaatgtgcaggtttgttacgtgtgtatattgtgtgacactgaggtttggtgctgagcatagtatccaatagctactattttggaccttttcccctcactccctccccactctagtagtccgcagtgtttcttgttcccatctttatatccatgtgtatccaagaaaacatggttttcaaccataatgctgtgttccacaaaaatatatgttcatgttattttattttatttatttatttttgagacagagtcttactctgtcacccaggctggagtgcaatggtgtgatctcggctcactgcaacctctgcctcccgggttcaagggattttcctgcctcagcctccagagtagctgggattataggtgcctgccaccatgcccagataattatgtttgtatttttagtagagacagggtttcaccatgttggccaggctggtctcgaactcccgacctcaggtgatccacccgcgttggccccccaaagtgctgggattacaggtgtgagccactgcacccagcccatgttatcatttgtacagatatattcaatgttgaaattttaaagtgaatttgtgataaaattcacaataatgtcagatatttcaccatcaaaagtataaacttccaatgaagttgatccagtgaataacatgaaagtaaataaattggaattaaataattgtaattaaaacaaaagaagggtgtaaggtttatgcctagataaacttttttgcatgtagatgttgtgttgttcaggaccatttgtttaaagactttttctccactgtattgccttggttcctttgccaaaaatcaattgattatatttatgtggatctgtttctgagctttctattctgttccattgatttacctgtctgttcttttgccaatattactctgtcttgattactgcagttttatatcaagccttgaagtcagatatcgtcaggtctcccacttaggaaactctttaaaataaatttttaagaaaacctttattcaggccaggcacggtggctcacacctgtaatccccccgccccaccccagcactgagctgggcggatgatgaggtcaggagtttgagaccagcctggccaacatggtgaaaccctgtctctactaaaaatacaaaaattagctgggcgtggtggtgcacgcctgtaatcccggctactcgggaggctgaagcaggagagttgcttgaacccgggaggcagaggttgcagtgagctgagatcatgccactgcactccagcctgggcgacagagtgagactctgtctcaaagagaaacaaaaacaaaaagctttacatttgtagctatttctttaaattagatagtcttttcagatacataaaaatatgtggattattgtataagcatttacataatttaatgtgcttagtaaatagtgttgtctagatgattactttttctctgcaactatttctgatattgccatattatatgaaagagtttccctctgtcgcccaggctggagtacagtggcgcaatgatagttcgttgcagcctactcagactactgtgctcaagcagtccttctgcctcagattcctgagtagctgggactacaggctcctgtcaccacgcctgactaattttttaaaattgtttgtttagagatggaggtctctcgattttgcctaggctgatctcaaatccctggactgaagcagtcttcctgcccaggccttctgagtagctcggattacaggcctatctcttaactatttgcttttaaaggaatgtattagatctgcgctgtacaatcacagttaacactggtcacatgtaacctttaaattttaaattatttaaaataaataaaattagattaaattaaatattcttttattttcaagtcatgctgaccacctttcaagtgctgaatacccacatgtggttattggctatcatattggatgacacagatacagatcatttccatccctgcacaaatttatactcaacagtggtgcagactgtccatgtatctgttatttgccctcccatctgtactccagtattttacctggaaatatttttttaaatgcctgtggatgtaaatgaagtcttaaaaaatagtctcatgtagaataaccttctgcctcaaattcaagagaaatctttgttataatatgattgttaagtcacaggtgtgttgttcttactatattttaattgcgttatagttatttgaatagttatgttttaggacatacacattgttatagtcaacacttcttgatgattatagtaatgtagttctactctgtcatagtttaaaatttatgtctccataggaatattattagctaaactcaatagtatgaaattctggctattgttaactgaaataattttgcatttgtggttcaaaatgtaactcttaagggaaataaaggaattcagaaagttttttgaaactcaatcttgtcttccttggaaataggagtactttgattatttttgaaagaaaaattagcctacagcctggtatttaaatatatatgtacatatattatatatttctgctaaattatttatggtagtttattttttccatcttatatacatactggattctcaatttgatttttaataccgcctatatacttattagtaatttcaatggtgtatctttaaaagataaatttcattttagttatgtgacactttatctttcattgttatgaattgcctttttactttttgcagtcttgcgttgaaatgtatcagaaactataatgtaaaaaaaagctgagtagaaatcttataattaaaagttgtagcaagtcatgaaaatggctcatgcttttattgccattttgatgtttttgatggcaaaagtgttgagaaaaagtctttagattcacgtgataagctgacagagtgaaacatcttaaggcttgaaagggcaagtagaagttataattattgtgtagattcacagtccttgtattgaattactcatctttgctctcatgctgcaggccatagagcgagaaaaagctgagaagttcagaaaactgcaagatgccagcagatcagctcaggccctggtggaacagatggtgaatggtaattacacgagttgatttagataatcttcttagggatttgataaacacataggttcatatttatcagctgaattatatcagacaagcacttgttaaatacaaatttaaattaaaaggtgtttgtatgttttttattattctttttttaatgctaaggaaattattaggagaaattcaactttgagttcattggaagaaaatgggatgtggtagaatattttatcagtctgtagcagagaaataaattttaatgcaaatctgctagaatttatccaaataatttaagaaaataaggttaacagaaatttgaaaacattaacagtcatgttatatgtgtaaaactgatcatcatctgattttaaatcatttttgcaatatgtttttccaaacactaaaattatatggaatgttttaccgtcattcctgttttgtaataatatatatgacattttctgtgttactttttatcacttcctctcatttaaaaaagaagtctcttcgggataacctttacttttaagtaacttttttagagtgagataaaagcacaaagctagccaagtttttgtctttctttttcaagaataaattaaaattaatcttttctaatactcagtgcctcaaaagttatgtgtaccaaatgtgtcattgacatgatatgtaaacaaccttctttcaaattatcattgctatactactatatttccagataaaattttacgaaaatcagggataatgctatttccaaataagattatttttcattttgtagaagacgtttacaagaacatcataaataaatacaacaaatgtttttgttgtgcatgtcagcttttttcagaatctgcctgcattttggggcataaattctgtgtataagttattttttgccttaattgcaaatttggcattcaaaagttcagtggtcttcctagaaaatcaattcattttcttcttctaatgagtcccatgactgactgtatttggttaaaaatgaaaacaaacaaatataacaggtgagacttgagtgaacaagtttaagaacaggtaatgaaaataccagtagatttttatttagatgtatgttgcttggtaattttaactgatcaacttaacagcatattcatgttaaataaaattatgtgatctaaaaatattctcctagttgttatgtaagttccccctagaaactgtattatcactttttcattttaataagctgatgcaagagctatactttaaatggtctcatgtcatagttatatatcaagcttacctacactgaattaatcagaaataatttaaacatttagaaattacgggaatgatttttaatttttggtaagtaaaactacatgcaggatttaaatgatcgtgtgactagtgagaatattaattttcttgattatttccctcatagttctaatttttggaggcatgtagaaaagtcaggacacatagtaggtgcttagtaaatattaattgaccagattctgtttagaaaagcaaaattaaggcagtcgttgaggtaataacgttggtaattttggtgtgaaaataataatccatctgaaggaaaatgctaactttggcagataccagggaacactggggggtaggggtgtgatttgagacattcctgtttggttgactgtgttaatcaaattttatgctacccttttgttctaccagtaaagatatggtcgaactgatacgtcattaggctcaagtttgggccataactaggatgactacttaaaatgaccatagctctgtttccccattaaataaaataatttatgaaattacttaaaggctcaaatattctaacttatctatttgttccgtttttgtcgttcaaggaacaaattgcataatatttattttctgtgattgtgcaaattgtgagataagctagacacatattaagtgcctgaagtaccccttcaggtgtatttcagagggactgctaccctaaatcataatagctcctttagtatagagcccaaaagtacagttgagtggtgtagctcatgaagctgaaagacaaatgaagctttctgtaaactaggagtccagcaattattgcattaaagctcttaaatttataagtccagaatcttccttcccaagcttaggctatggagatataataaatctcacaaccacgtaagacacatacattcttgccctttttgtatagaaaggaaaatgagagctgaatcagtgtgcttcatttaggacctcatgtaaatggctgttcctcttaaccacgtatagtttcctcagaagttaagataaagatgaaccactcttgtataaaccactcatattattatgccactaataaaaatatgtgcgtatatatttataaatttgatgtgtgcttaccacagtgaaaatatttaacatatattcatagtgtaaaaatatgtagaatagcataagtatagctattatagattttaaaaaattctgtgaactatattttatatgtatctatactggtatatgcatagcaaactgaattttctacttaaaataatttgccctaagattaaactactttttaaaaatttagaataattttgtaattcatcagtttgcttttagaatgaaattccaagatggaaaaaataatttctcataacttaaattttacttcagttttgacctgaaatggtacatcagacatatttccaaatgatttctgtccgtttctaaatgtctatgaagcattgaagattcaacatcacttaagtaatgcagaaaacaaaatctgtttgtcctgaaggcaatttgttgaaggaatttaagacatatgctgagaagacaggatagggtgttaaggttgttgaaagtacaaaatttaccatggttacaatgtagaagggaacctcatttgatggtgcaaagtattgttaaaaatcagttgtacgttctagaaacagtatgtctagtaacatatgtacagtttttcagtgtcacatacaagttttatgatcaattggaagatactttttattttcactgtattttatcaaatgtgaagagttgtatgcagaattttaaaacagttaatattaaccatatcattaattttacagcaataatttgtatattaagagtttattgaccgtaagagattcttactaatttatttggaatttttaaccaaagaaatgagttggccaaattccttgcctgctttaaaactatacatggacgttttccttatggatgttccagttcttttggtcagagtagaagtgatctttcacgatcatagactaaaaagagaagctactaaaaggagagtgttaactaaaaaaaaaaatcacgtttctggcattttggcatgaaattttggtataatttttaactgatttatctctatcttagctgtattttttgtttgaactaacattaaaattaatttactgttcttatgtcagcattaattggttggataaatgtgacagaatattggatggtgcaaagtacctctttttactagagacatttttggatagctgtaattttcatgcagcttaccgtcaatatgtaagctttggatcataaccctggtctcaggaaactgttaacttaatgagggcaagtgagaggctagaccaggtatctagtgatgtatttatatattcatgtagctgtgcatattgaaaagggagtttccaaattctttattttactttttaagaaagatgtgatataactttaaggtttatttttacatttcttaatttaaatacaaaatgttataaataatttagaaatttagaaaaatttagccattaaatatagtaagtaatctttctaatgctttaataatattgctaactaataatggttttctaagattttaatttgaacagtctttaaactgatgcctttcatgaccaaggcctttcagtgtattattgagattgtggagttttaggacaacctagggctaaaataatatacatatgattatacctaaacatatgtctgtttttatctatttaggattagacgtaatcctttttgtaaaacagtgttctcgcatgagtacatacagtctcatcaatcaggcataacacaaaaaagcctagtttagataaactggttttccatattaatactgaaattaccaaaagatgaccatatcaaaacatttatttgaaaacatatgtaggcgtagctcaggttctcgttctttagtctctaagatcctttcaccataatttctagaggagatactataattatgtaatagggttagttaaattgtgattcattttcaatttctatttgtagttttctgtgtgttaattaagagtctaaggacagtcacatcaaggacatgtttaaataaaagtagtaattattagtatattagactaaagaacatctcaaaactatcattccctgagtgctagattatagtgtttaaggtgatacctgataataagtatgctaactgttgtaattaaatggcacagaatgataacactgacgagagctcttcttatccataacattaaccaagtaactatctttttttcttgtattttggttcatagctcattagataatttcacatgaattatgttatttgaggtgggcaaccagattttgtcagatgggtgagggtagggattatggtcagtctggctcatctcaaagctaaaactctcatgatcactggaaaaactttcagtagcagcaagtcttctaatcatatattttaatggcaagacatattgcaaatagtctgtatacaaatgtggcatggagactgtaccacttgtagtagcccagccccttcatcatgaatgagtagccttccacagttgcatatatttcctcttctcttattccttcctcagtactgggcagtttgatttatatttcttctttctccacatgacacttagtataatgctctacacagagttcacattcaataaatgtttttaattgacaggcacatttttcttcgtttaagtctaatctccaaaaggaagagcctctgtgggtgtgtgtgagcacggcgtgcatgcacgggtgaactcgcatgcgcagacatgtgcgtgtgtgtgtccatgtgtgtgaaagaaagagactgttgttgtcactgttgttgtgggaaatgagtggccaaaacaaatatgagtaaaaatctgactttttttaattttatgatgtttgaaaataaaaacgcaaaagggctatattagtaaaatttatattgccctcactaggggtattacttttatatatactattaatttttaaaagctattactttaagtcagtgtggtcacagaaacctctaaaatttagcctcagaacttgtcttcacaggttttgaatatctctatattacattttagactattacattgaatgctaaatggacttgtaataaccctcacttaaagttcagcaaaaataggagactgtttattagcagctttattttaagtttctattccaaatattcttttaattcaagagctctggaaacacttgttttgtgttattctaccctggcttcatggctaatgatgaatatacttgatgaggaatacttcactttaagtggcagttctgaagtacttgcatggaaggtggtgcacatttaacattattctaacagtctgttatgcactgtacacaagtaataaaattaatggatacacttcaagtaatgatccatttcctctgggtgcaatatatttattcacagactatttcaggggttgtttagaatatgagatgtgaatggattatgatccattatccctgagattctaatgtgctacaacaaaatggtttccataagtattgctcataatgcctggtgtgttagtatttgtattcttaaatagctaacacaaaattagaaaacagatgctcagatgattgatacttaaaacttttcagatatttacacttacaaactcttagaaaagttaaaattttccattgagtcaaggagcataattctatggaatacatataaaacaattatatataataataaaatccatatgcaaatatttacttggataacgctttgaaccctttttcattctagaaaggttttaatggactttcttagaaaatcaacagtagttctggcatttagatggtcaattaattcataaagttgaagtaatagcatttctcattttaattgaagagaggtacattaagtaatgtgacagtgtcggttattaacgtgacagtgtcagtaagtaacgtgaccatcctctccatcccctgcccaagtattttaaagcaaatttgatacaagagagattgtgtgcttgtttgtgtatggcttttggcttcagtgtacattggtctcataatttttatattcatatagagtacactattgatttggtattgaatgagttcatgagtacagtgtagttatactctttctactccaagctgagaattctattagatactgccagtggagacatttcctataggagtttatagtttagaaggacagtttatgcccttgttgagcaggcagcatattcacaatgaattaatacaatgtttgcatacaaatccttcatagcaagacttctgattttctgtgcccaacattatgtcttttctagtaacatctagaaatttccacgttttttttgaaatgttttcgtttctttataacttcaatctcacatgattataaatgtggcagaatattccaggattcccaaataaactctttttatttttattttagttggtgacaggctcttgctctgttgcccaggctagaatacagtgatgcaatcatagctcagtgcagcctcgaactcctggtctcaaaggatccctggttattgataaaacttctttaaaaaatgtataaatacaccttctatatcccatattagtcatatattatataaaattaggactaattttaaaatagtattattaactttttatacatgtcctgtttcagtcattaagaagacttcctctccccctaattttcacacaagagagctggtcccttgttttctgaatattctttttcatttcctctatatggcattgtctaatatgtctttgttgcctagtatgtgtcagcatttgttataagtaagttatatatgttaactcagaactttggtaagtatcctatgaggtcgattctatttttaatcctcatttcatggatgagaaaaacaagatccagtgaaattaagtaactgaacccatttcacacatctagtaaggggcatcaaatttgaactccggtctctttaacgccagaattctcaccggtcatttctctgcctttctgcctgcctccccctttttgctattatagatgtcgttcttttacctatcactgcattttcattgcctgcattcagttataaagatcaatatgcaaataaatagagcgtattataaatttcagtgttatgaatttgtacaaagctgacttttcttcaccatttaaatttcttttacagtgatatattgcaacattttttggggggcaaaacatagagttttgtgtaatgatcaacaatgactcattaaaacctgtccctagattttaacggatactgcagagcctattggtacttcactgtagttttatcatttaacaaaattaacatatccatattgaaaatcaacttatagtttcattttttcatttgctacgatttgtatggttgacctttctcagggacacaaagtgatttctctctgtgttcccgtctcatttagacaaatgttgaataagactcaatccagcatcagtctatcggtccctttaatttagcatttcttttttgcctgtttaatacctggttcatgttgacgtttcacccttcatggacttctaactgcttgttcaagttcaacatatgctgaaaatatttctcctaaatatctgatcatttagatccatgccacattttttgttattaacataatttaaaaattctgtccagtatattttctaattatctttttattttccagaaatgttaacgttttatcataatacttttttcaaacggagtgctcatacgattgaagtttcatattcttctcttacactttataccaaatgtggtcattttataacaacagttacttaatcgcatcgcttaacaaatattttggtacaatttttgatcactcctcaaaatctaacgatcaaaaacagcatgtcacaattgcttccttaagcattaggaggatattagaatatgtagctcctgtaggccacggacttcttttatacttagatatatggagccatgtatatattctttttacattctattatttccattgtatctcattaaaaatatatcagggaagaaggaggggaaaatagttgacgataatatttgcaaagtttgtctccttcaccgccatcctgagtagcattatgctttgaaattagtgaagttacagttgtgtttcaaatgaattgagggacatggtttggcagcattaatatcattatgacaaatagaacattagactatcagggcagagggaagtgaaagaggataaaataatatagttgttgaattcacatctatattttttttagtctttaaaaaggataaagtgggaggcatgtgcaagttagcaaaaccacaggccttatgtttctagagacgttcttcagactttttaagaacttagcttccctttaactaaattatattaccagaaaattaagtaaaatgaacatttataaaagtagattatcttaggcaacctactcttctaccaaactactcttcgaacttttaggtattttaacctagagaaagaaccttacagtgagtttatgttcttttgagatctctgtaggtacatgagggaacataaaacatttaaatattcagtatttccaaagtataagaaagttatcagtgctaatgtagctatgtttaaaaatgcatgatatcatatgtaatatattttctcttttatattctgtcattaagaaaactatataagctaataaatctaagaaagtctaaattttgtaaactaactttagagagtttgaatattttaacccatagcacagcgtgatgttgccatgctttcatgctatgtatggaataatatgtacttggactggcgttcgtcatatatgaaatgacatagcatattccatggtacatagtaggtactccagaatggtaatggtgataatgatatgcttgtgtttccatttttcccttgataaagttttctgggtttggtattactacagatgattttaaaactttgagatcaacttctacatttataaatttaaaaatgtttcacattagaaagattatttttcctagtacttgtttttcttcctcgcatccatggacaatatgagacagagtctcgctctgtcacccaggctggagtgcagtggcgcgatctccgctcactgcaagctccgcctcccgggttcacgccattctcctgcctcagcctcccgagtagctggaaccccaggcgcccgccaccacgcccggctaattttttgtatttttagtagagacggggtttcaccgtgttagccaggatggtcttgatctcccgatgccgtgatcccccacctcggcctcccaaagtgttggaattataggcatgagccaccgtgcccagccgacaatctgtttatttctaatcttctgtaaatgaaataaagaataatcttggattttttttcctctttttaaaactatgaaaatactatttaaactaatttccaagcccatttttaaaattaaaaatgtaagttagtttggggaagtatatttgagtaatatgtatgatatgtaaaatgtatctgaaaacatccaaaatgttacttgttcatgcagccttccagctcccatcagagctttgagcacttttgtttttatttaagtttttatttaatattttatttacatatattctaattttctacatcttatgtcttattacttgatggcattgatattcattgttgtgacgcaagtctgataattcacattgaataatctgaaatcatatttacacatttatatcttagaaaataattgatctggtttgaaatcattcatgtggtgaatacttttataattaggatgtgttggctttcagatcatttctttcagtctgtgggttcaggggatatatttaattatttttttctttctagagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggtaagaatctcttctccttccatttggagcataatcaataggtatttcttggcaatttccaagaagacagtaacaaattatttagtaatgaaacgttcaccttctaaggatttagctaagcgcaataaagttcaaaatgtaagcaacagaaatctgtttaaatatgtaagacgtagatacccggattctaaaattgtatttggcgtagttacacagcgctaattgattgtgtcggtttgcgtaagcatgaggcagtttaggagtgtggaaaccacatgtatcctgtaaaaaatggcctctcactttggaactctttctttgtgacgagtgaaacatagtcattttgaaaaagtggaatccatggaaatagttagaaacacgggtcaacaacaagcttggatgcagtataactagatacataaggaaaatatttaaaactgatggacctctcaaattacgataatttgaggaaggtttctttacaaaaagatatttttaaaatgtagctggagtacagaggaaccacaccggatagtgtagtaacccagcatcagagttcttaccccttttagtccagaaaggatcagtgagagagcagttatagaaactcagaaggagacagtcagatcctcatggtaaaagcagcatggccggcttaaggaatcctcatagaaatggagtcagacaaataaacaccccacttcacttttttccctgcctccagaatcttgtcagggctcctcactgactaaacttaatcgtaagacaaaggacaaggaaccgtcatctgtaaatatcagtctcctgggtaacaggagaagagcggacagtggatctggaggggcaaacaagatgtaagtggacaaaagggcctgagaaagagatgaaaggattatgccttcaagtgtaagaaaacaagagctgtataataatgaaaatagcctaaactgttttcattgttactatgagctatgtgcttttcgcggggaatgagaaactgattagaggatggactaaaacgtttccaggatgaacgtttagtgatagatcgagatgattacatttaatacaaaaggcaaggagtggagattcatttgcatactgtaaaaaagaatggcttaaataaaggtagaatagacatggaaaggtgacaaggttgatttagaaaaggtattggacccaaaaagtgatgagaaattcaaagctattttgaagagaaaaacaattgaaggacttaatggttcttcaaatatcggacctgtagcattattaggttttctgttcttgtgttagtttgctgaggaaataaactcagaaagtatacttttggataaagaataccttggataaggcacttgacttgttaggcaaatacacacatctaaggaatttctacattgagatgcattttgtaatttaagaatagaaccaatgccgcttttcctgtgaatcagaggaataatccaaatacattatttcttgccacaaaaatctgatgttaccttatccgattcttgagattcagatatagtagttagtaatagtacctacacagtacattcatgcataaaatatatacattaagtgtctctaatgtgtttaagaatgctactgagtgtattaatcagctgagtctgccacaataaataccacagactcggtggcttaaacaacacaggtttattttctgagagttctagaagtgagagaaagtccaggatcaaggtttggtagggttcagcttcatcttctggtgaaggctgtcttcctggcttgcagataaccaacttctcactctgtcctcacatggctttcctctgtgtgtatacatgcagagagagagaatgagggctatttttctttctctctctctttatctctgcctccttttataaagccaccaatccctaagggattagccccccaccccgccacccttacccaaccctgatgacgtcatataaacatcattacctcttaaaagtcctatcaccaaatagtctcaccaatggttaggacttcaacatgtgaattttggaagacacaattcagcccatagcactaagttttgggaatattagagtgggcattcatggactctgcttttattgtatttacggaaagcagagaagagagatatgaaacaatggaatcaatatttttaaatttcctgctaggaacagtggtttaaactaagatgcaaagctttgggagaatgagtaacagggaaaaacgaacctgatacagccaccaagggcatcttccttgagggaggaacatttgagttgagacttttgtgataagttagaattaggtaagagaacagttaagcaagattccaggcagaaggaacatggcaagagggagcaataaaggccaagcacctgaatgaagaccattgtaaatgctgaacatagaggggcagatgaatgagaggagagacaaacaggaatcagtcaggtatataggagacaaaccaatgacttctgggacctgctagtatcttggtcttgatttgaggaacaaatggagatcaccagaggttttatatattaaatattgtctggaggttgaggaagtcatcctaagggaaaatacttctcttactgcatccaaattccgttgtcacctccttatcaccccttactctttctctcagacccattggtgtctattaatttgaagaatcactttaggtaaaatatttagcaagataagcttaatattattcatacaagggcaaatatatatactgttctgctgagattagtgataggtaaataaattataacatgtttctcagcgttttattttatttggagaagttttataacattagagcgcatatttagctcatattctaatgatcggcagaactggtttttaatattgtgggggttagagagccttatcagaattggaaaaaattcatgaaccctttcctgtgaaaaatacaaaagcttccatgagataagcatataattttaaagaataaacagactcaaaggagataccatactctggaggaccaactaaaccaaatccttttatggaaataatggctaattgttcacatctttttaaacacagaatacttcagttgaaaagtatctcttctatgatttattctcagaacattaaggtctcaactgaacatttgcccaaatgttttattagtttcaaagtcccctttgtttttcagagcacacttggctataatgttggctctttctatagccccctgaacgggaaaaatggcagccctccatctggccaaatataaatcaggttcttaatggttcacagtagatgccaatgctgccatttgtaaatctagcatacaaattatttgtatatatttctgtactataaatacagaatattaccctttacctcttgtcttatttcttatccatggatatataccaactttctagcactggtttgagaggatttatatttgaaagagaaatataggtcaccttccattttgctaaacgtctttaatcttcacccaccaaaacgattgaatcgtcagagattattttacctgaatcagctcataccattataaccacataaacacattcctctgaaagctgtatttatgtttttttaatgagaataagtggcattgtacattagtcttgcaaccatgacagaatttatgtgataaatttctcagcctctcctaatacaaaagttactctctcccaaagagtatgaatgcctccataaatattaactttttttttgccttttcactttgattttcaggaagctcagatttcaattcgttcagaattggtataattctttccattttctctttcttctaatgggctcatgttccaatttttaaatttcaattttcctgttgttacatattaaatagtaactaaccctcaagtatttttttctaaagacagcatatatatgaattgtaagtaagcagccatgataataacacttttaaaaagggcagtgaaaactttgagttcaaattatatatgtattaaatacgaaacaattccaacttcactggaaacaagaacatgaaaacatttatgtagagaatagcatgcccttcgcccactttttgatggggttgtttgtttttttcttgtaaatttttttgagttcgttgtagattctggatattagccctttgtcagatgagtaggttgcaaaaattttctcccattttgtaggttgcctgttcactctgatggtagtttcttttgctgtgcagaagctctttagtttaattagatcccatttgtcaatttgtcttttgttgccattgcttttggtgttttggacatgaagtccttgcccatgcctatgccctgaatggtattgcctaggttttcttctagggtttttatggttttaggtctaacgtttaaatctttaatccatcttgaattgatttttgtataagttgtaaggaagggatccagtttcagctttctacatatggctagccagttttcccagcaccatttattaaatagggaatcctttccccattgcttgtttttgtcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgtcctgttggcttaggattgacttggcgatgcgggctcttttttggttccatatgaactttaaagtagttttttccaattctgtgaagaaagtcattgtccaaaagaaatacagtgctagccacaaattcaagccacatatgtaatttaaaatggtctagaaactatattaggaaaggaaaaagaaacggtaattgaatttcaatagtacattttatttaacctgattcatcaaaaatattatttgaaagtgtaatcagtatttaaaaactttgagattatgttcttagcttttcttaatcttcagaattaaacatattttggtaatttcatgcatctaaatttggaccagccacatttcaggtgcccagttgccacatgagctagtgacagtacagcagtgttcatgtgattttatcatacaaaccagggtactactgagagtgaaacagggtgctactaataattatgccaggacaacaagaggaaacctggacagccaccgtaatttaaaaagtggcaattggctgggcgcggtggctcacacctgtaatcccagcactttgggaggccaaggtgggtggatcatgaggtcagcagtttgagaccagcctggccaacagtgaaactccatctctactaaaaataaaaaaaatttgctggacacggtagcgggcacctgtaatcccagctactcaggaggctgaggcagaagaatcgcttgaacctggaatgtgaaggttgcatttggccaagatcgcgtcattgcactccagcctgggcaacaagagcgagactctgtcccaaaaaaaaaaaaaaaaaaaaaaaaaagcagtggttgcctgtttggtcaggagaagtaatgagaccatacaaaacatagaagattatagatatatttttatatttgggtgtgtacatacatatgtataagtattatatagattttatatgtgtgtatataatctatataattgtatcaaaatatatttataattatagtatacacatatacatatatgtaggtatatatgtaatttatattttgcagaaatgaaagagaaaatattgttcattgagtgagcttaaaatttgaagcaagcgcacatcattttgatataagaggggtgcagccaaacacctatatttgatttatggaaaggatttaaggtcatgcatagtatttttccactgtacgcattcatacccattaatgctctaaattatgtcatcttgaaatttaaatatcattatataggatgatacatattgaacaaagagccaaggtatccttaaatgtatggctggtgatagaggcttgtctatactgtcatggatgtttcttatcagatatttgtgaagggtattaagctaaacttgccttactgctttttaataccttcttttgcaaaatgtaatgtatgcaaagtaaacgtgttacttactttccatactctatggcacaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaagtaagtaaaaagcctaaaatggctaacttgacattttccaaaatggttatttgtggggaaatccagaaggtactaacatgaaacaataatttctgtaaatggaaccattctccctacaacctgtattaacaaggaacgaaatactggtgtaacagataagctgtctgtagatttttttgtcctcataataattttgtgactttgagaaacaaaacatgttttgtatgggaatagcttctccttgggggattgtagatttcaaaatcagatgttttgaatatagaagaaaataaaagagcagttgaggtcatatgaatacacttcaattaagtctggctcgctgtatatacaaggatatttgctaggcatcttctaatatttctgtcaatttatctgaagagtattatagctttagcatacatgtggcaactgaaactcagcaaaggacaaattattctttgggctacattttactactggatcactataattacataaatcctattttttcctttgatgataaaagataaaagtggagcaattatgcaaattcatgccatgcgactagcaaatttttcaagatgtttcttttgtctcttcctgaattgctttaataagatgatgttaatacatagtatctgctccaaaatatctctactcatcaacttagttttaagacaaaaattcttttcagagacagatgaatgaccacctttaagaaatagtaaatggggttttgattcactatatacatgcatatatgtgttcatgtgcacacaaaaggaattattgagtaaaatcgggtttgaaggcattaagataaaagtatttttctgaaaaaatctctgtcccaaatttgtcatgagaagcacaggaacatgtgtttgtttactactaaaacttaaattagttggaaaatatattatcctattgcttttctttgtaaatatttaaagaattcaccatataatatcatttccagaattaatgtagtgatacacaacgcttttctcatttcccagcttttcattttttacaaaaatgaaatgagctaaataaagcaaaggataaatactttttttttttttttttttttttgtacttcagagtcgtttttgctaaggggtttattttcctgtacaggtagtaaaactttataaatagtatcagctccctctagtggatttcagtatacttgttactgtgcctctgcaaaatcaatttgggaaaatattttaaatgtcctagattttcaaatattgacatatttaacaataatgtattttcacttgtcattacatacataactcccccttaaagttaaatacatttagtggctatgcagcaattgttgtgcaaaggagccatttcactggaaatttactttaatctgtatatacctcttaatcatattaaagttcaactttttatcatttactttaaagatgttcagaatagcaatgtttgataactgagatttgtctatgatgttacaatataaatacgtaataatatatagtctctattcatacagctctccatccatccatccatccctatcatctttcttctcttttttaaatttcatacctacaaacgatgattgtttataaaacttcctaactttttcactgctattatatgtaaacaaattgtccccacttccactgtagctacacatctttaattttactattcacccttttggaatgcttgtctagattaataaataaccctttaattaaatatggtgtatatatatatatatatatggaatgaaaaatgtagcatatgaaattacatagcagttgattttgttaatttgaaattaattcaaataattgcacatgtgtatgcattatatccgaactggcaccagggagtaaatctcatttcttgtattcctccacagtactttggacgtattaagtatgcaggaaataagagctaacagaagtgcctaggcatccatactgacttttatttcctctttacttttttaaacttgctttttcacacaaaaacctggcttttaaaatatactatcagtgttggaaaatggcataaggaattggtagttgttacctgacataagtgatagaagaaaataatataaaaagataaaattctattttcaaagcactttttactctatgcataactaatttatacatcattttacctaaccctcagagagaaacacattgagtatttgttattacaactatatcacaagtaagctaatggggtttgaataactaaaagcatggatatgggatgctgtaagaactagatcgtatacacgaatgtccataacaacattattcataatagccaaaacgtagaagaaacccacatgtccatccagtgatgactatatgaagaaaatgggcacatccatacaaggcagtgttactgagcaataaaaagggagaaagtactgatacatgctacagcatggagtacccttgaagacattatgctgagtgaaagaagccagtcacaaaagatcatatgttatatgagtctcttgatataaaatggccacaataggcaaatctgtacaggcagaaataagattagtggttgcctaggtctgggaggatgagggggtggaattgtttcccatgacagttgataaaatacttttctagagactgaaaaccagtaaactcatgttatatgctagatgaatatagaaacacagcatctagtctgttgtagataattgtttcaacaaagaaaaaaatgaaaccttatttcttaatgtaaagaaggaaaaagattggtcatataatttgagtttatttcattaacaatttggaaatcatgttaaaataattattagggattttattggtttggtttagttttgcaaaaatggagaaagtgacattattagttatgacaaagccagtgttttgactgttctaaagtttcaaaatgattctcttctgttctacaccattagattgctttcagaacagagtcttgctcactttttcactaataaattcaagaaatatttttgaacacctggtatatgccgtaaaagtgctgggcactaggtaatatacatggtggagaaaatcaagagcaatatgtcttcatggagcttattgaaagaaagataataaaattgaatatctgaatattattgcagattataattactttggcgtctgaaaccgtgattctggggagatgatgttagaaccaaacctggagaatgtgcaggtgccagctatatgataagttggagaaaggacattaggagaaatgaaaagaaacacaaattgccaaaggtgaagaatgagggcttggcatgtccagaagacataagggaggccagaaaggctggaatgtaacaaatcaatgaaagattaggacaagatgagggtagaattgctcttatagaacttctataacaggtttggattttaagagcagtagacatttccgaaagaatttcaattgaggaaattaagtacccttagttgtattttttcaaaactcaccctctagctggtatgtgaagaagaaatgcaatacaagtctgaggagaagcaggaagacttgtggaaagaatagccacacagaggagagtccattgaaccttaaactacagttgtgataagataaagaaaaatcatttcaacccttgaagaggtgatgatctggggaggtgtagcacagaagatattcttgccagaattgaaagaaaataacttttacctcttacagagacagtagaagaaaattttaagggtagccagcaaggatgctctccatggccacaatttcaagctctatggttagtctctacccctccctgttaggatgctgagactgggaattaaaacaaagtttgatgtgaggtaactcttctagctgcagttcaggaaattgacctaatttactttattaaaattttaaattttttattttaaaattttatttttaatacatctaggcaaaggaatgttttgttccagtagacacataatctgttgcattgctccttcactccagaaactaggtaaactgtttgtaaatgttccttttaaaaattgtgttatttttatcaataccatcaagagcaagcatagcagacatgtttatttaagcaagctatgtgcttattgtgagataaaagaattgttccctgacctcaagaatcatgggaaaactcgctaaatgccaagttaaagctatacatatatatatacacacgctgtgtgtacatatacgtatatgtacacaagttgtgtgtgcatatacgtatgtacatatatacacatactgtgtatgtacacacacagacacatactgtgtaaatactcacgtaggcaaatattgtgtatatacacacgtagacacatactgtgtatatacacacgtagacacattctgtgtatataaacacgtagacacatactgtgtatgtacacacgtagacacatactgtgtatgtacacacatagacacatactgtgtatatacacatgtagacatatacacacacacacacacacacacacacatttataaaatttatgtgacaggaacctcatactattttccaaaatggctgtactaatttacattcccaccaacaatgtgtaagtgtacttttctccacagcctctccaacatttatctttcatcattttgaaagtagccgttctaattttaacatgtgtaaggtgacacatcattgtggttttcacatttttctgatgtttagagatgttgagcattttttcacatatctgttggccattggtgcctcttattgcgagaaatgtctgttcatatcccttgcccatttttaaatcaggttatttgttttcttgctgttgagttttttgaggtttctatatattttggatattaactccttaccagatatttggtttgcaaatattttctcttgatctgtgagctgcctcttcactctgttaatagtttcctttcctgtgcaggagctttttagtttgatgcaatctaatttgtctatttttgcttttgttgcccatgccatatccatttgagcattattcataacagccaagatacggaaacaacctaaatgtctattacaggacgaatggataaagaaaatgtgatatatatagtgatatatgcatagtggtagatatatatagtgatttatatatactgatatatagagatatatatactgatatatatagtgacatatatatatagtgataaatatattccagtgtctatatatgatatatatatgcaatggaatactatacagtctttaaaaggaaggaatttctgtcatttgccaccatgtagatagaactggcggacattaggctagctgaaatgagccaggcaaagaaagacaaatactgtatgatctcacttatatgagaaatccaaaaaaaagtcaaattatagaaacagaaaatagaaaggtagttaccagagactggggggaagaggaaggttgggaaagggaaggtgttgatcaaatgatagaaagtttcagttagactggaggaataaattgtagcgatctctagtactgcgtggtggacacagttaataaaaatctatgtttcaaaattggtaaaagaatagattttaatatccgcatcacaaaaaaagataagttggtgaggtgattaatatgttaattaacctgagtgaatattttacaatgcatacatagatcaaaacatcacatgataccccataaatacacataattattatttgttagttaaatatgaaatagtttaacatgatattttgaaaataggattgctaagtggatagagctgcttttagaaaaagggaaaattcagcaaaagaaaaaaactcttaaattctaataaatatttctgtagtgtggtagtttatacttacacaaagttggtcagaaaaatgagacttacctggaaaataaatcagttgtccaggaggtgaataatagagcagtatttatgaaaatgaccccaatttcagttggttcattggagttttatgacttataaaacaaattctatggtgatcttagataaaattcctataaacccatctatttcactcatgtcagaccacaccaagtgccctttgtgagaatggagcctgagcagcagcgactttcagcagagcaagttgcataagcaaaaaggcgtgaagtaattaaaaggcatattttgactggaggatagaatattgattttgataggaaattgggctaaaatgttgattgaattcccaatcacaaagatccttgtatttcaaactaaggaaacaacttatatattgacattagaaattcaagttatactcagacttccttgcacttgtaattatctgaaggaccattcctagtatgttaatcatcatatatcatgcatgggtcctgttgtatttcttgacacctttgtcagtgttcacattttagagaaatgcttacttttgtcatggtctatgttatttaataaagtttggagcctttgctgattgcattatctccttgactttagattgatcatggggaatgaggaaaaaggtgggatctggttggcatggaattaaaggctcaagttgagcattttgccgaagtaggtatatgtcattagttcagcttcttcacacatgtgcagtgcatttttttccccacaggtaataatggggaattcaaattggactcgatttcatattcacaacaggacttctaatgtttttaaatgctgtcaatattaagactactaacatatcatctctttctccccctaaatggattacatgggtgccttttccagcttctatctaagcactatccaacagaaaaataatgtgagccatatatttaattttaaatgttctagaaaccacattaacagatcaacaggtaaaagtcatttgaaaatattgtttcatcttagaattaaaattttaaaatgtggaaatagctttacattctttttgtatgaactgtccaatatctggtgtgtctttatatatacaaaacatctcaactcaaactggccacgtttcaagtgcttaacggacgggtagccagttgctaccttattggttggcacagttacgtcttccttctctctattgtacattctctgatgcttaagtgcctattttctgagtagttctatttttcaagaggagagattttttttttcagtaaagtgttatatataaccgattgctctggtatctctttatctcgatagttatgtctctcagaattttcaatatacttctctgtttactttgctttccagttaaagtggtttgcccttgacatagactcatgtgtattagaaaatgtagcatctaatttcatacttagctcttttgttatcacaaaagaatcttgctttgcctctcttggtctgtcctttgctctccttttttctctcttcttttccctttagcccctccctcttttaagagttaaagacaagcagtttttaaacaaaaggtgcagaaaacttcttttttgtattcctttactataattttagatgtcagtttgcctatactttatcacttccatccctcacatggctatattaaatgtctagatattaatggaatttttttttttacttttcaagataaacagtagtgcaggataggagcccttaatttttattttcccaataatttacagcacgtgcttccaagcttgcaatcacttatattgattttcattttgttgaatatatttcactaataaaaccaaaaagatatctgcatttttaaagtggtcctttagcagccgaatagtagaaactgtcataggaatactttctttagagaaaaaagttacatatttataagcaatatattggctaaacgttaaatcttcaggccatatttttcctgagtctgtgctgagtctaatgatgtcagtagaactctcgaggtcttttaagatggtaggttattagattggatatgtttattgtcttattgctgtcagtaaagataaacttatctgttggattattaatctctatttctacataaaaggaaaaaaagtgagtttccgtagatggagctggtctatttctgctcctatgttgggatcacaagggcagcatctacagatatctcaccagctagtaggtggggcagctcatactgtgtttgcccttgggtacattagcttctgtataagactttttctttcttcttatctgaaacagatttagaattcttcactggcattccctggcctgcatggtttaaatgagatactctataccgttgcaaatttgtcaagcatttcctgaaccttgatagcaattactgctgtcattacatagtgtcattacattccacataagaaaatcagaaaaagaaattgtgatatttatgttagtaggtgtgtatttttttttccagcttgcctcacaaactatattagatggacaagttcccaaaccaatctttggaagtttatttcttaaagctacaaaagaatttccaagagattagattttttgaaatgaccagtttcaaatgaatttaatacaaaactaggatgagggttggaatgcaaggaggaattaaaatatgcatgttttaattatagtttaccaatatgaagtgattcctgtgagattcagttgttggacagatcagaagttatacagaaaaagatcaataattcagagactgaagtgtttcagttttcattaaacagaaagaccagaaagaagttaaagaggagacatgttcaagttcaattaaaccaaattttatgaagcttatgattcatccaacataccgccatgtgtctgcccatagtcccctctccttctagatcatttgctgaaatgacatctcagacacaatcatttgcttcattgtaactaaatacctctttacttcactgctatttataaggtcccttttggattttgtttattaataatcatctagaattcaaataaatgcatatgccactcttgccactcctcttcagcatagtactagaagtcctagccagagcagtcagacaagagaaagaaataaagggcatccaaatcggtaaagaggaagtcaaactgtcagtgtttgccgactatatgatcatttaccttcaaaaccctaaggattcctccagaaagtttctagaactgataaaataattcagcaacatttccagatacaagattaatgtacaaaaatcagtagctcttctgtataccaacaacgaccaagcagagaatcaaattaagaactcaaccccttttacaatagctgcaaaaaataaaataaaataacaacaacaacaacaaaaaacttaggaatatacctaaccaaggagtcgaaagacctctccaaggaaaactaccaaacactgctgaaagaaatcatagatgacacaaacaaatgaaaacacatcccatagtcgtggatgggtacaatcagtattgtgaaaatgaccatactgccaaaggcaatctacaaattcagtgcaatccccatcaaaataacagcatcattcttcacagaattagaaaaaaaattctaaaattaatatggaaccaaaaaggagcctgcacagccaaagcaagactaagcaaaaagaacaaatctggaggcatcacactacctgatttcaaactatactataaggccatagtcaccaaaacagcatggtactggtataaatataggcacatagaccaacagaacagaatagagaacccagaaataaaccaaaatacttacacaaactgatcttcaacaaagcaaacaaaaacatacagtaaagaaaggacacccttttcatcaaatggtgctgggataattggctagccacatgtgggagactgaaattggctcctcatctctcacattatacaaaaaccaactaaagatggtttaaagacttaaacctaagacctgaaactataaaaattctagaagataacattggaaaaaactttctagacattggcttaggcaaggatttcatgaccaggaacccaaaagcaaatgtaataaaaacaaagataaatagctggtacctaatttaaattaaaaagcttttgcacagcaaaaggaacaatcagcacagcaaacaggcaacccatggagtgggataaaatcttcacaatctatacatctgacaaaggactaatatccagaatctacaacaaactcaaatcagtaagaaaaatacaatcccatcaaaaagtgggctaaggacatgaatagacagttctcaaaaggagatatacaaatggtcaacaaacttatgaaaaaatgctaacattatgaatgatcagggaaatgcaaatcaaaaccaccatgtgataccaccttactcttgcaagaatgaccataatcaaaaaaattttaaaaagtacatgtttgcgtggatgtggtgatcaggtaacacttctacactgctgatggggatttaaacaagtacagccactatggaaaagagtgtggagattccttaactaaaagtagaactaccactcgatccagcaatcccattactgggtatctacccagaggaaaaaaagtcattattcaaaaaagatacttgcacatgcatgtttatagcagcacagttcacaccagcacaatcgtggaaccaatccaaatgcccatcactgaatgagtggttaaagaaactgtggtgagtgtgtgtgtgtgtgtgtgtgtgtgtgtatgtatgtatgtatatatgatggaatactactcagtcataaaaatgaatgaattaacagcatttgcagtgacctgaatgagattggagactattattctaagtgaagtaactcaggaatggaaaaccaaacattgtatgttctcactgatatgtgggagataatctatgaggacacacaggcattagaatgatataatggactttgggaacttgtggggaaggttggggggagagagaaaagactacaaatagggtacagtgtatactgcttaggtgatgggtgcaccaaaatctcacaaatcaccactaaagaacttactcatgtaaccaaataccacctttacccccaataacttatggaaaaataaaaaataaatgcatcaggttaatagagaaacatattatttatgtaaattaaaacagattttaagtactacaaatatcttttaataagaaatcagaagtgctcagattaaatataatctcttaacatttttatgagttcccaaataaatgcaatataaacatattgaaaaaaattatccatttctaacatttcagcatccattgccaacacactctctaagattatcgcaaccatctgaatactacattaaatacatgcaaaatactttcctatattcttctcatttagtgtagaaggaattggtatattgaaatgacattcatatcccagcaattaaaataatatgatttagataatgttatttgatgtggtgatataaaccaggactttgcagtgtgatttcatgtatttagaaacattattagccattatctgtttaaatatggcttctgccacattctgggatgcatatatattagaccgttttactgtgttctctatctttttgtgtctccatgcttcattccaggtatttccttctgaatcttaagatttagtaattttctatttacccctgtcaaatttgctgttaaacccatgcacttaattcttatttttcacttactgtatttttaattctagaatttcttttggattatccctaaaatatgttatgtcctttttatggtttacagttctctgcagcgttctcaatcttgtgtctaatctctttcaatatagtccatgtggctgcttaagtcacatttcatatatatacatatacacatacatactttaaaacgtataaacttgtttgtatatacatactgtatatctctatataatactttccctaatataattatacatataaaagtatatacatacacatatgcctctttaatagcctgttttctcaattgcaattgggattaacaatgtatatgtctcacaggtttattataagaattaagaatgataatatttatggggttattactagagttcttgatacatatactaagcatgcgtacatgggtgttctttcagtaaaattagacatgacatgatataatttaaaaatcaaggtcttcggataatgatactattttttttccaaggcaaatgataacactgagagagagtagcctttcagtatcagatacaattggaccctgctcggtttctgcaaataccatctgtatcaccttgggcaatttacttagcttctctgtttttctgtttcctgcccttatctgtttttctgtttcctgaccttataaaacgaattgaacaatatagattttacaggctgatttgtgaatttaatgtaatatgtgtaaggtccctggcatattacacatgtagcaggaatgtatcttcataatcatattaaatatatttttcagattttctaattttgttaatatttgaaactagtaatataattgagtttgctgacaatttaggaaaacatggcaaagtgtgaaacaattaagtgattctcattcttttttcccttttgataaagtttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggtctgtgaatatttgaatgtcaaaacaataaagcacgcttatcaagcattcacattgatataacctttaaataatattagaatttaagtcattctgacaagtatggtagtttgcccattgagcaaatgaaaatgagactttacagtattatttatgcatatactctatctatggatatatatgtatgggcatatatacatgctgtttttgaaaacaattgtatgatctatttatgaagtatatttttaatttagcatgcattttcagatgtattgattttgattattagaaaaaccattgttttattccccacctttgcttctttatttgtaactcctgtcacattctcaaactggtgggtaaaatcagtgtacagtcatcccttcgtatccatggggaagtggttccaggaactcctatgaatatcagaattcacagatgttcaagtcctttatatgaatggtgtaatatttgcatataacttatgaacatgctcccatatactttaactcatctctggattacttataatgcctaatacaatgtaaatattatgaaaatatgtgttatactgtattatttaggaagtagtgacaatgaaaaagtcttacatgtttagtacagatgtagttatttttgtcaaatattatctattagtagttgactgaatccactcattcagaatccacaaatatggagggctggctatatttataaaattggtttaaatttaaacattaattttctgtaatgtaatgagacatttgaattctaatagctacatttttttaacatccttctatcaggaaagatatactaatatgggaaatgaaagaaataatttgtaagagattttataatacttttcctactttattttatttttagacggagtttcattcttgttgcccaggctggagtgcagcagtgctatctcggctcactgcaacctacgcctcccgggttcaagtgattctcctgccttagcctcctgagtagctgggattatagtgcgtgccatcacgcctggctaatttttgtatttttaaagtaaagatggggtttcaccatcttggccatgctggtctcaaactcctgacctcagatgatctgcctgcctcagcctcccaaagtgctgggattacaggtgtgagccactgcgcccagcccttttcctacttattataaaatactacattatatgttcaataactttttatttctgaagacatgaaaacgtattagttatatttagaagctgagataatatgtgcattttaagaaaaatgtttaaaaattcaaatttaaactttatcacatagaattttttttggataattaaatatttttttgaagtaatgtattcaaagaaaaatacatttaaacaactttcattatgtattgtcctatttagatatttattctactacaataccaaatggtagctgtttcaccttttttgtttccttttgttgtggtttttaatgcttggcataatgattccaaagtctatctggaaaaatgtgttgcctaatagaactagtaaacttttaaacataagaataaaaatgtgcaagaataagagtggagaaaacacaagaaaaggcagttagatgagcagaagagactatttccactgaaaaagataggaaagaaaataattgttcataaatattattgggaaatgtattaactaactaaaaaaaaagatatgaacatttcccccaaagttacaccaaaataaaaaccacatacaataaaatgttcaaaaaatgtggggaagcccaaattttggaaaatatttaaaataataatgttataaaaatttaggtggagaagcataaaaatcgatggaaacaatcacaaacattgtaaaaacaccagagacaattttaaagaaatatgataccaaggaatctttttttttctgtgagtaaggaagaaagtcttgagtaaggtatcctccaaaaagagacatatatgaataataaacctatgaataattgtaacttaaattgtaaaggaagaagtaaaaaaattacaagatgagaattttttttgcatactaaattgcatacacacaaaagatataagtaccaatttgcaagtggtgaaataaaaattgtctcttactgctggaaatgtaaattcaatatgaattttactgaggttaactcttcagtgcatcctaataacatacaacattaatataatttccatgaaatctgtatctgatggaaataatcagaatacactcaaagatgtaaatggaactggagatagataggatattgattgattgagggatggatggatggattagataggtaggtagatagagataaacataatttacaggagtggaaaactagaaatgaatgtgtagaactaataatggaaattgttgaactagaaaagccattacaatttttgtttttgaaaaaataattatttgacatgggcaaatgctcacactaaaacacctagctcaaagtgtagttatatgctagatattgtctaaataatcagtcataggggaacaatttgaaaaagtgaaataaacttaaaaaagtaaagtaaaaaaacaaattaagtaccaccaaataggcataggatactatgaaactataaaacttagatatttgacaaattttgggttgatataggtcacattataggggaaagaataactgtttatatgtgcatacatgatcatatatttaatatttagctatacatagaacaaattgaaaatttatataaagtactagtagttctggtttttttttccatttttgtcatgagcctttattattttataaagtaaaagtaacattaaagtaaatattgaacaggggaagtctaaagttatgatcctactgtaagaaattacatgtgttatacagaataagtataaataaattttataaattctccacaaaactatccttgaatcccaccataatactacataacagaataacattttttgaaaatatattaagtacatagattgttcaataagtttttctattccatatatcaatattattagctatagttttatgtagagtttactttcctgaaagctcagtataattaatttcaactccattaactgtatcacaaatgcagttattaatatatatacttaattcagtaaaattagatgcaccaaaactttttggctctgtaagatatagttttgagatatatttgacattgttcagaaaaatacatatggagtgttaaataccactaaataatattcaagttactcttaggataatatgtaaaatttaaattaccactagaagtttataactgatagaagatcatctactttgtttacatgtttgaatcatatagatttcaagtacagttaatttcactaaaactcatcaattattattcatcaattagggtaaatgtatttaaaaaattgttttttaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcaggtaattcaagattttactttctaccctcatttttatttacttgttttttccctaacgatacactgtaaactgtaaaggtacataagcatttgaccttcagcatctttcaaagttagtgagaagatgaaaagacatgagtcttttacaaaggatggcgatttgcttattccttctaggaaaagaataggagttttctcagtgtttttagaatgaattttctattttcaccattaccaataggaattaaacatgtttttagtttaataattttcaaaaccaatcatccatttagtctggttgtcttttaagatacgggtaatcatttagcttatgactagaaaaaagttatgtatatatacattatacagaggtatattgtaatcattttatatatataatgtatagtatgtatatgattatttcctatattacctttcatttctgctgttttgctacttataaaaagtaggagtcaactatgctgtctatatgtgctattatatataaaatatggtgatatgttcataaaattgcattatatattcatcccattatgtataactccatatatgtatatgtgcagtagaaatgtaggtgtattaatgtcctatgatactcctaagaaattagcagaaatttaatggcttcaaacaacacaaatttattacattactgttctggaggtcagaagttcagaattaatctctgtgggctaaaattaaggtgttagcagaactgtgtctgttttggagactttgaaagagaatgtgtgttattggcatttttagcttccatatatatatgtatatatatacacacacatacatataacatgtatatatgtgtgtatatatatatatatatacgtgtataatggaattatatatcatgtacatatatacatatctaatgtaatatatatcacatatgtaacctgttgtatatgtatattaatgttacatatgtaatatatagtaataacttattttatcaccatatcgaatttgtaattatatgcttaaattttaccacatcaccttcttcctgaaaccaaattcccttgacttaatttgtttgaatagtgccaccatactaataaccactcaagctaaagaaaaacagtaaaccaacaattgcattaaggtctaaaagcctaaaatattcaataaggtaagtaatgtgtcccttgagtggtcaattattgtgacaaatgttaatgctgggaaggaaatgtcgaaaacgttatggtatgatggaaaaacattgcaacaatatgctcctggatttaaatcccagtctagctgcttagtttttgtgcttaccttttacaaaccaaagcactaagcaaacctaaaacattttttaatgcatagcatttctttacttataaacatatgtgtacatgcatacctatgtaaatactgcatgaaaatatctattatttgtcaagaccagtggcctaagagggcacaattacatggctcttgttatcaaggagcccacattctagtgaaggaggaaggtaggtgtattcatttcctatggcactcctaacaaattgccggaaatttaataacttcaagcaacacaaatttattagagttctggaagtcaaaagttcaggattagtctcagtgggctaaaattaaggtgtcagcaggactttgtctgttttggaggctttgcgacagagtctgttttattggcatttttagcttctagaagcattccttgtctcatgtccccatcctccatcttcaaagtcagcagtgtaacatcatctagtgtcaatttctctctccctgtctatctccctctccctctctttctacctctccttctcaccttcctttccctatcctgttccctgtgttgacttccttttaattaggacctttgtgattacattatgccctggtggatgatccagtataatctccccatctcagaatccttaatgtaatcacatctgcaaagtcctttctggtaatatactcacaggtttcagagattagggtgaggacatcttgggggtagcattattcagccttgcatggtaaataaattaaacagtatgggaaaggttgtcacagtaggcaggaaggaaatccaacataaactaggaaaaaggattatgaaatattatcggaacataggttgtctctgctatagattaaataggtagaatttagttagctaataccgagaaagaaagagttcttgagaaagcatagcagcattttcagttaaatgatataagttcaacactgggtagacaatatatatggggattaataaaatattatggttggaaaactggattgagagtagacagtgaatgtccttggatgctatgttttacaatctgagttttaatctagtggtgatgggactgataataataacaataaaaacttaataagaaaaaactgctattggttaaagagggaaataatatgattccacttgtgttttcaaaacattcccaagatgagaggaaggaggagaggagattactggcatcactgtagatcagtaattagaatgaggtgagaccgaggcagatatcaaaacgagccagtgcattaatggagtcactaatgagacctgaacagcccaggcgtagtggctcatgcctataatcccagcactctgggcagctgaggcaggtagatcacgaggtcaagagatcaagaccatgctggccaacatggcgaaaccctgtctctactaaaaacacaaaaattagctgggcatggtagtgcacgcctgtaatcccagctacttgggaggctgaggcaggagaatggcgtgaacctgggaggtggaggctgcagtgagccaagattgtgccacttcactccagcctgggcgacagagcaagactccatctcaaaaaaaaaaaaaaaaaaaaacaaaaaacaaacaaaaaaaaaaagacctgaacaaggacagtgaagatgtgaaataagaacaaatgtagacttgaaagataacagcaaggtgatcgtcttgaagttctcttagataaatagtttaaaaattattattaataatcacattaaaggggaaactttctgtggagcacatattttcaatgtaaatttaagtaaaacagaagaaaataacacatgtagacagcatagttgaatcatactttttagaagtggcaaaacagcagaaaaaaaggtaatacgggaaagaatcatgggtgagagatactggctatttataaatgataaaagatgatgatttttacctgatcattacttcgtactggtcagacaaataaaagcaaaagctctgtctttgaagatgacaaaatattagtccaaaagttcccaactggaaggactatttaaactgtcatctgtagaaaataatttgtgaaagttcgggtttagggaggctataaagacaccattacattgagtttattgttcatagtttgttttatgtactgtaaggacacatttttagtattctcatgagttgttttgtaacttaaaatttctctagagggggatatgatttaatgttctcgagagtaacatcataaaaccacatttggtagtaattttgtatttttaacaatagcagacttcacacaccagtgctcatacagtagaccataaaaatgcagtcttagtaaaaatattctttgcctcaagaactacttagagacatcctttaaacatgggaattgtttttgggcctgtgtttagacataacacaatgatgaattgtgttaaaagtaatcagcacaccagtaatgccttataacgggtctcgtttcagaatcacatacaaaccctgaagaaatggatggctgaagttgatgtttttctgaaggaggaatggcctgcccttggggattcagaaattctaaaaaagcagctgaaacagtgcagagtaagatttttatatgatgcctttaatatgaataattttgtatgaatattatttggttagatcagtgttttacagctggggtggattttgctctcctctccccagtggattttttttaatgtttctagacgtttttgattgtcacagctgggttgggggtggtggttagatgctactggtgtctaataggtagaggagagagatgctgctaaatatcgtacagtccatagaacattcctccagaacaaggaactgcacaatctaaaatgtcactagtgccaatgttgagaaaccctgggttgagtaaatgaggaactgacaaaacattgccttgtactcaacctcatttgataacattattttactataaaatgcagtataatttaaaggtaaagaatcctttgagctacttgttatttcttatgataaattactattcatactgtgttgttctcttcatctataatgcactgtactataatataacacagtatgcattttgaaataatattcattataccattgtcatgcagcaggaagaaaacaatcttgctctttaaggaaatttttttacaatacaagctaaaaaagcaaatccacctcacaaataaccttcacacccattacactgtaaacaatttctgcagtatcctgtgtttgaaaatgaaaatactaacaaagataataaagtatgaagcccatcattttcacacatttttctaaccagaaatattaaatttatttccttttgtttctgatataagtagaatacaaataattccccactggattcatgccataataaccattgaacatttttgcaagactgttaggcagtcatctatatcaatatctctgtatctcagattttaaaagacaaaaatccatatgcaatgccatcagtcccaattttacattttctagctatgtttcatatctaatatgtggcagtaatttttttcagctggcttaaattgatttattttcttagcttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtatagacaatctctttcactgtggcttgcctcaacgtacttaactaagatttcctaatgtctcccttcaccgttacttttggttaaggctttgttcctatgtttttgctttaaagcacaattaattctgacaaattaatcttttttctagcatatctaaatattttcatggtatatattttaaatagtacacattcatcttattttgatcctaaaatgactttcttgaacacaactgtcatactaaaaaatgaaatcctattcttagtcattatttccaatccatgttttcttcagaacataaatgtataataataatgggattaagaaaaatttgttacacggagatatttggtacaaaataaaatgcatggctaatatatgtgtatgtagaaataggataaataattataactttcgattaacatttccaagtttggcctcttcgacacatttattatttatttattttattttttgggacagggtctccctctgtcacccaggctggagtgcagtggtgtgaactcggctcactgcagcctcaacctcctgggctcaagcaattctcccatctcagtccccacaagtagctagaagtacaggtgtgtgccaccatgcctggctaattttttgttattttttggtagagacagggtcttgctgtgtttcccaggctggttttgaattcctgggctcaaacaatgctctttccttggcctcccaaaatgctggaattataggtgtgagttaccacacctggctgacatctagttttaaataacaattaagattcagtaaccattaagaatagctgaatttcaaaaaaaaacacacacaaaatgactgtacactcatatttgagtttctcatttttctacagaagaatattttatagatatctctcttatatttaaatattcaattacggatagtaagatatattcaaaaatagtgtatatcaaatacttcttgttcgaaagataaaattttgaactaaagcaatgaatacttttaagttcaccaatacattagtccccgatcatctgcagttttgctttccctggtttcaaatgcttgtggtcaattggaatcctaaaatcggtgagcacagtaaaataagatattttgagagggagaagaagagagataacttgttctattttattagttgttaatctcttactatgcctaatttataaattaaattttataggtatgtatgagtaggaaaaaatctagtgtatatagggttaggtatcatctatggtttcaggcatctattggaggtcttggtatgaacatatcttccaaagatacaagggaactactgtacctttttggaaattaataaggggtttcaatttacgtgttagaggcagttggtctttggttactgctaagtaaactttcaaaatagaaaagaagtaatgtcaaaaggcaaaagctacatttgaaaatgaaaaaaaaaattagaaaagtcaagggaaatcactcagctaatacaatcactgacaagtgttcattggttctgttaattcacagatgagctgtccctgggtcagctagctcacattcttctcctgaagtaagtcagtgctagaagagttgtttaggaaaaaaaaaaaatattacttaaataatagattataccattgatgttttcctggaaggccagtgtgaaaggtatttgttttttgtttgttgaatgttcttaatggatgaataaaaagaacatcaccaatttatgtagagcaaggggaaaacatcagccaaaaaaaaaaagtataaaaccaacaatattactaaaacctcaaggtttttacattttacaggagtacaatttgtaaaggctctctaaaaatgtctttgcttaagaccttatgtctgttatatgtactaagaatttgttgttcaagagatatattttaaacacactcatctgttgcatagcaaaaaagctatagatccaagctatgttctgatctccattttctaatcttagaatattatatgtatctgtgcttttcctacaagtatcactctggccatgttctgactttgtagccaaatgagttaggttgtaaaaggaaggaacaatggcgctcaaggagaagaagaagacgatgcggtaaaaacaaggaagccatatgtgaatattgttaccaattcagcattccagagagaataatggaaatgaagtgtaaatctatgcattacagaaatatctacagacaaaataagtgtgtgatacactcttttgggttaaagataattccttttttgtcaccagatgccaatgtctgcgaaaacataaataatttgaaacaaaattgtccaaatatctgatacatttgaagatgctttcacatcccatgatctaattttgggtatataaaatggttattattttaaattttaaagggtatgtatataagtttaaaaatctagattctagctatttctaaaaaaatgatcagatataagtgagggaataaaatagacattgtagttaccttcacggagataatagtttagtggtgaaaatggaaagtaaataggttaacacattatcacaacaatgtcttgtttgaagtcttgcttacactctgaatgtagcaataagaaccctttaaatgagagtgacaggagcaggaaaactactttctattgggtagtcagtagagtgttttctgaagaggcgaaattaaagctgatacccgagtagtaggaacttgacaatttgttgtgtcaaggaattctgccagaaaatgaagtggagaaaacatctgaggcaagagagggcttagcatgtttgaggagctcaaaggaagccaggagaaaaagagtgggaaaatgagtcagaaaggaatatggaagccacagtgatgatttagtcattatgtcaagtactttggaaagtcatctgacttttaagcataggagtggcatcatttcatttcatttaaaatggttgttttaagtttgctgcatattcctattagaagaagaataaatcaaaagggctgaagtggaagcaggtagggattgcaattgtccaggtagaaaaaaaaaacaggcaggaaaaaggggatatttgtggatattgtagttttctgaggaacctccatgctgttctctacagtgactgtaccatttatattcccactaacagtgtagtgtagttcctttttatctgcatccgtgccaacaattattttttgtctttttggcaatatacatcctagctggggtgaggtgatacctcattgtggttttggtttgcatttatttgatgattaccgatgtggaatttttttttcatatattaattggccatttttttcttcttttggaaataactgttcagattatttgcccatttttgaatcccatcacatccacatatgatatgatgttttatatcataaaatcgttatttttctttttatgatatctgagtttctagcttctgcacagcaaaggaaacagtaaacagaatgaaaagacaatccacagaatgggaaaaaatatttgcaaactactcatccaacagaggattagtatcctcattacatttttgatgaggactttcacacttacatctacccagaagtattattcctatcctaacatgacacattcctttattctttttaacagatcccattagatctggcagtacttgctgaaggagagtgtttgttgatagtctagaggaagaatgagggaagaatcaaagtgttttcagatatatttctgttatgagctacattgtaggtcattgtgattttaaagaaagagtgggtactaagagaagaacaaaatggaatagcttactagagtgactagcggttccatcttagccatatttatttcggagaaaaagacaatcagacatgtatctggaagtcaagtacacttttcaaactgggcatataaacgaggtacataaaaataaagataacatgtatataagatactgtttcttgcctattgagaagatttccccatgctcccatccctaaaatgcttggtcaaattggataattcgtaaactcttagagatggaagagaatctatttttgtttaaaccactttgttgaggtatgactgacataccaaaagctgtacatatttaatttatacaacttgattagtttggggataagcgtatacccatgagacttattaccacattcaagatgataaacttacctatcacctccaaaagtttccttctgccccttaatttatttattttttttgttttgtgataagagctcctaagatctatcctcttggaatatttttaacaatacagtatttttaactataggcccaatgttgtacagtagatctgcagagctaattcatcttgcataactgaagctttgtatcctttgggcatcattttgccattttcccctctctcagcctttggaaaccactattctactctctagttctgtgagtttgactattttagattctagggaatggaaggaaatattcacaaatcatatgtctggcaaatgattaatatccaaaatatataaggaacttctaaaattcaatagcaaaaataaaactgaaaaataacctgattaaaaatgagcacaggacttgaatagtcatttctctaaagaatacgtagaaatgaccaacaggtatatgaaaaggtgcatcactaatcatctgaaaaatgcagttaaaagccacaagaacctcttcatacctgttagggtggctattatcagaacaaaacaaagcaaaagatactaagtgttggcaagaatgtggagaaaagggaattcttttatggtgttggttggaatgtaaattggtgcagccatttgggagaacagtttggaggttcctcaaaaaattacaaatagaattcccatttgattcaccaatcccgcttctggatatatatccaaaggaaataaaatcaggatctcaaggaggtatctgcacccctatgtttacagcagcaatatttacaatagccaagacatggaaacaatctaaatgtatattgtcaaataaataaaacatggtatatgcatataacggaatattatgtagctttaaaaaagaaaattcttccatttgcagcagcatagatgaacttggaggatagtatgctaagtgaaataaaccagacacacgcggtcaaatactggagaatattttttttgtggatggaaaggcacagtgtgtaagaccagaagctctgagatcagatcgcctgggtttaagtctatccacatcataaactgcctgtgtgattctagaaaagttgtttaacctttttgtgcttgagtctcccaatctttaaaatgtgatgatattaatacataattcataagtatataataattaaatgaattcatcttttcaaggtgtatagagcctcatctaacctagattaatcactgtacatgtttgttagatagaaaacaaatagaaacctacatatatagaattataaaacatgtatactttctaagtaaataatatatggttatatattttaattattagtggctttaaatttatagtaaatagttatcaataaatgggatttagaggttacgtggatgtctttctgccagcttgcagatcattgtctttctctgggtcagtatactctttgggtgtagtgatccccagatctctttcgtcagatctctaacagtctgtttttccatctttctgcaaaaaactagcttcttgttttaccgagaaaatataagcaatcagaatagaagttgcagtactcccactgacctgcatataagctcacagactctactttccctttgtttacatagatgaactttctgtgcttttgtctaaggccagcttttccacttacgtacctggatccctttcccttgtctctgcacaaggacattgtaacagctaatgaacagccctctacctcctacatcttctccacgctacatcattcccatcattcccatcagtagagaattattctgtaatatctcctgtcatttaaaagaatcctcaattggacaacaatctctctagcaacctctccattcccgtttccctttacagacattcctttctctccatttcactccttcccttctctcttgatgccaattaagagagctaatcaaactgttatcctcactattctattaaagcagattttgtcagggtcatcagtgaattcgtattactaaatcgctaaattcagttggcttctgtgtcatcattctttcttaattatctcttagttttccctgaccactgtcaatatccttggtggttctattgccctgaccactaaatttgaaagtgttccagggctcagtctgtggactccttttttttttccccctattaccacccactctccgggtcaacttatcaagctccatagttttaaatgtaatctgtaagttgttcctgctgtaagttttttttttttttttttttaacaatctggaccctttctaatgatcctagacctgcatacccatttgcccactcaacacctccacatcaattaataataggcatattaaatctaacatgttaaaacaaaattcctgatgtataccccagtctactaccctagaaatttgcctgttattacaaatggcacctccatctttccacttattcaagccaaatcccacgagattttcttgtctcctatatttctcttacagccgaacatcaaatctatcaccaaatgctgtcgtttttgccttcaaaatttccaggatccaacaatatctcaccatacttgagcacgtgcacacacacacacacatacacacacacacacacacacacacacacacacacacacaaagtatgtatgtgaatgtatagtttttactagaagtcttggctgaattccattagtccctctaatatttttgtagcttcaccaactgccttaaaagattataacagagcagagtttctaagtagaaatttagcagcaggatttcttaatttataaaatagcaaaaatagcagcatgttttcttaagtttattataggttcattgactgcacaaaataacatttataccttttctagtacaattgcaagacatattgttctagatgtgttagggtgaaacatttatttacattgtagtagatcaagtactacatttacctaggtaagtaaagaacctaaaatgaagtattatctatattaggctcaaaatggttgtaaattataaggaaaatcaatgcgatagtgattctacacatatttactattgggcaaagtaccatgaacacttcattttactaaaactgtgcattatatattaatactatgaaaactctgttacttaaaatgtataatgttgtttcaaccagagagaagaataccatcttttgaatagagttactttttaaagtaaaagcactatgtataatgattgtaatactatagagtgccttgtaacaaggtgtatgattttcttttagatgttttaagttttgcatttttctggttaatgagtaatggagtccattgtagaaagttttagttttcaaaaatgcgtgaggctttaaatagcagatgttttctataaccacagacagactcttttgcaacttgcattttacacgtaaaactttatattgagccacttttcatttcagtaaagatgtatttgtgatgcacagtatcccatagtatatatatgtcataatttaatctctcatgaaagcacctttgggtttgttttcaagatgtttggtctttaaagctgaattaaatattgtacatgttagtctctacactttggttggcatgattcactctcaaaaaatggagcagttgactcagattcgtggacattaacatttttatatgttttgccatcttactatctaaaaggttgtattatgttggatatttccctcaacaagtataaaaactttgattttcccacatccctgcccaaaatgggctctttattaattattatttttccctgtcttaacatgtgaaaatgcattaattcacttcgatttgcaatcatttaactataaatggtattagaacatcttttatatacatgtattgccatatattatcttctttgtgaattgccaaactacgttttatgcacttttcgttttttctttttaatttatgagagtttctgtagatacatgattatgaagttcttagaatatttaaaatagtaaaacattatgaaagaacacaaagaataactatttctatgtatgccaataaaattacttttccaactgaaacatattattttaaaaagccttgtttttctccattcacagaaaagcattgtcacacaaacagctgaattatcatcatcgggcaatacgttcattttattaagtatgccaaataaacagacatgtcttattttcacacttatgggaaattgagtgtatctgatccccatgagttattttcttatgcatataagctttttacttctttatcattactatctaagctttctgttatttacatactgatgaaataatataataataatgtttcatcactgtcaataatcgtgttttgtttgtttgttttgtggaaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaaggtaaaaaaaaaaaaagaaaaactaagtaaaacaaaggaaataaatggaaaaagaaagaaatgcaacaatgcttgaagttgtatacagtctgctctttcctggttctaagagaagaggttgatttttaattaataattttaatttagcttcaagtttaatatacattttaacaaccttaaactgtttaattttaatgcattgtggtcaattatgaaaattgaaaatcacaatttgaaacaattttcccttgaaatcatgtagtattaagagagcagaatcaactcatttcattaactgtctgtagctgatgtaaatgtacgttgaaactgtgcaaaagtattcttgaaaagacaaatttataatgtagtcaacaaactgtgttaatttggtagtttgaaggcatttctgagaatttggaaacactaaatatttgaacccgtagcctttaatatggatagaaaggactgagtttacatgtacttttcttgaaacaataggacaaaatataacattgacttattacgaaggaaactggtatgtagtatgtagtatggatttggaggtgaagcctggacttgaacctacatagtggcatttcgtatggccttgggcaacaatataatagtcaatataatcctctgttttatcatgtttatatcatcatacttcctcacttgaatgtatgaactgttgattgtaactaccatgtgagtaaattgcctaactcagagttggtgctcaattagtagctataatcataattattatttttatgtgctagcaagaacttagagaatgacttgaaatattaatactgtagatctttttttggttcaaggattgtgacaaggaaaaatcaatgtggagccagatacttgagtttaaaacttagttcggccccatgccaactgtataaattggggtgagttacatgagcttactgagccaaattccttcgtttgtgaactgggtatcagaatgtctgctttcagaatcattagagggatgaaatatgaaatttctaacacaatgcctagcacagtataaatgaccatgactcattatttattattttaattgtgaaagggccacatggtaaaaaattatataattaaatggtaattcagaaatatctattatagttaatagcagaaagtaactcacatgaaaactcagatgtttaaatatcgaatctgtcatacggctttagtcaaatgttgaaagtaaatatctaatatactccataaatatgtataaatattatgtgtgtataaaactataatgaagaaaaaattagtataatcatttctagagtattaaaaacacagaattattctaatctagcaatagcatatttatcaactaaaacttattgcatacttactgtgtgccaaacaccctctggctactgaatatagagggtggtgagcaagaccactgccttggaatttacattctagtgttctagcgtgtggtgaggagcaggcaataaatggaaaaataaatgaaatcatgataatttgcctagaagtaaacatggattttgaaatcaagaatgaataatgttcaggcaggatttgagggtggtaggatgctattttagaaaaacttgacttatagagcatttatgaagaattgtatgtaatatgagagaactgaatcataaggaaaagccaaccacttaaaaaaatctttatggaaacacattctattcagagagcatagcttctgcaaagaccctgaagctaattgggaagagaaagaaatctgcctgaaggaaggaaaatgggataaaattacctcagataagtcttaggaggtgggcaaatatctgttaacaaacgggttttgttagagtatcacagtttttattctaaatggacaagaaaaaccattggagtatttcaaaagaccaaaataatttaaaatttgactttggggaggtcacccctgaggaaaactttatcagaatgtgagagctagaaggtactttgaaacttgtgtaattcacacttctctctctgcttatcagaaaactgcaattcccagataggtcaaatgatttagccatagtcacagactttatttgtggtagagcccacaggattgaaggtattttattctatttcatctcttttttcctttcctttcctttcctttcctttcctttcctttcctttcctttcctttcctttcctttcctttcctttcctttcctttccctttccctttccctttccctttccctttccctttcctttcccttccctttccctttccctttccctttccctttccctttccctttccctttccctttccctttcactttcactttcactttcactttcactttccctttccttttcctttcctttcttttccattgtgtgtcactcatatggccttttctcttgtatctcaattcctttctcactgcgtctatttatatatggccactacctcagatccgtaagtagatactatagagtcatttgtgttcagctgctctgattatccctgggttcctttggttcagtgcctcttctggccctcttccctctccctatgagcgatttgcctatgtcaccaacaacccagtcagatctctcttattttcctgtgctctagagtaaactgtctcaaatttttaaaatttgaaaaccatccttgaaatgagtgttccaacaaatttgtctacattgattgacatgttttgataattggtctagctacaaaattggtttagtatgggggtgatagtaaaaagaggtaaactctggaagcctctggcaacaaccactggaagagttggcaggaagatttcatttcttgagttttcagcctgctactcaagacagtttctttaaggcaacttcactacctggaggttagcaatagtaccttgtccagacttctacctgtgctcatttgatagctaatttttctttattgtcagaagatactaacagacctattttgacatctctccctgatactcaaagaagaaatagagacccccccttctgtttatgttctttcctgtgttttacctgaaaatggaagtgctgttttaataacttatttttcccctgaaaaggaaagtttttttgacataaaagaacccagggtacagtttgataaacaacctctgactttaaaacttttatggagatcagcaatcactatatggtaaaactttatactaaaaccctttgaaaaacactctggaaagttattaactggttttatttttttttaatttttactctattataactctagtactagtgcttaccagaacttacacataaagtgagaatagtaaatacacaaataaatttgtataatcactacagcagtgattcctgcatctgaatggacatcagaatcacctggaagtcttgtttaatacacagagtgctgggccctgaccccagaatttctgattcagtgagtcttgggtgaggcctgtagtttttcatttttaacaagtttgagtttgataccaaagaacaagttgcagagtgattccaagggtgctcactttaagaagcacgggtgtgaaatcctagcaatgaaagatggcagagcatatcatagttagattcatggaaagaaacaagagccaccgtttttatgaggatttgtatagaaactgtaccagtcatttagctttctaccttttctcctagtagagaaattcatcatcatcttctttcctcatatgtacctggattaataaattttgctgtttgttcttcgaacctttcccaagatctgagcctcttattaaaccaagaatatatgaagtctaaaaaccatggaaagaagtgttcttcattctacatttttatatagttgcttgggttatttataatgagcataaattgtaattttattcattagactgactacagcatgctccttcttcagctcatggaacatttgagacccgcttaacagaaactatgagaaagagaggatataactctgaggatgatttccttaaactctctgaacctcagttttctaatgtccaatatagaggtaacaaaacacatccgagaaggtttgggtaaagatctaatgaggtagcacttatgacatggctggcacagaacacagtagcacatattaaatgatgaatggtaatcaaacttgttgattatactataattactaaagtcaaaatgcaatttgtgtaaaaacaatctctatgctcagtgatgccaaaaagctgatttatttagaatattgaactaaagatttcaatcaattaaaatcggtgaagttaagcattctatagacaaaacaatttgcattttctgacataatgcatacttttaaggaattgtgggactaaatccaaaggagtagggtgattatgctgacacatacaaaggcattttatagctgaccttatccatatcctgccaataagcccttaccttaaccaccgcattgtatgcaggcccaacttctacattatagaacctgagttcctttacttgagggctttctgtggccactgaatcccacttttgcacttgtgtggtaggcttgcaagtactgggaaattaacatttccccaacagcctttaacaattagggaagatgatacagaaataataccccaatttcttcacccctgaatgggataacccgcaggcatatatttctcagggctttctaacaggattaaactctagtcattaacagtgtttgctgggattaataagtatgcccatatggatgtctcttccctttcttgtctcaattccccattcagctaccagaatttcttttacatggcacacataaataaactacttatatttgaaagctaatgtcaggtttgacccctggaggaacacagactaaagatacagtgtgtatgtgtgtgtgtttctaaaatacatgtacgcatttgaagttaaggagtgtaaatgtctcccaaccgaagaccaccaccaactctcttgtagctgaacaagttgggttcattattttttgcaatgagggagaatacacaacatggaggccagggggtgcgtgtggatgaaaaaaaaaaaaaacattgtaggatttgtgcttgtgttaggggatttgagggagggtttaaaagctttactttggattgcttgtcattagtgtgtagggatagctatatgggtatcgtatcttgtccagaaggagagaagaccagaatgaggctaaagttgcaattaataaagaaacggcgttcgttcatattaaccaggataggagagtgttgggcgttttgtggtttgggtaatgttgatgtttttgtctggattcagacatgattatggaatgatcttgtcatggtcttgatccattatggaaacaaagtggccttttccaatgttgaaattctgtgaaacagtttattttccacttgagaagaccaaggcatagctgggtgtcaggccagcttctgatatcagcagctccttttttggtttctctttctctcatgtgttttcaattctcgaacgaaactttcttttatcaaaatatgttcctaaatatagcatcaaggggacctttctatgttaagtatcctttaacttaaataatgatatttgtgatggtttcaatattattcatccaagtaatttataagtgatttcaattctagactgccaaatattttttaacctagttaatattgaaatatttgtttcttgccttttccaaacaattgtatttatatcaatgtgtatatatttgaccacaaatccatacctccatgcagactacttttcagtctattcttgttacagatctgttgtattcttataataaattatttctttaactttccaatttcaactaaacttaaatttatggaagagactggagttcatattagatttatttttgtaattctcattctaactgggatgttgtgagaaagaaattatatgattcatagaaatgcattttggatgtaaagttattttcatgctattaagagagcattctttatttttcagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagtcagttgcttttcttggtctttgtcaatgatatgtcaatacatggtcatatgtgaggcatagtggttaagaacatggataccagtgcaaaacaactttggcttgaattcctcattcaggcacttataagttgtatgactttgggccatttgcttaacttgtgtaaacctgttttcaatctgtcaactagacataatacataattcataagttgttgagaaaattaaatgagctattctctttaaactacttagcctagtactcaatatatgtgagtagctatgcttctaattctcattactattattaggtcataaaatcctataaattttctccagatttatagacaatgatctttattttttcttatttttgtatgtacataaacttatttaagtatctttggggaaaagcattctgtagagaagtatgtttttactacaattgtctttagtaattgccgtgccccatagagttctttgttagacatgttacctaaccagctctatattttttgatggtttgcattatatttatgtattatcacaacttctgctttaacttttatggatgggccttactgtctagattatgcttatctgaatttagataaagaaagcaggtgcctcaaatgatggccatgtaattgcatcaaaaataagctatgacctttcttatgaaaatactgtgccaaggggcacaaaactttatccactacaaatgctgatgctgccagacattgcacatgagttggactttaagcccccttccctcacacagactgagttattttggtgaatatggttaataaagtgttcaggtacctctttacttttgaaaaacattatttagtttgcttcctatgttgagggtttgatatttaaagaaagatacgattcagatcaataataaagtacacctttaaaaatattttaaaatgtatttgtagctaaagtaccccatatattcccaatacagtattatcattttccaattgtaaaatgtgatccgagtttctccattatcagttctaagctcttctttactcatccttattcttttcttttaaatgcaattcactcctcagactcttgaaaagtgccttctatatgtcaggaaatattacagtttctgaggatataatgacgtatcttatgtatcagtgttatgtgagtgctatataaaatataacaaagaatgggaagggaagggatctgatggcactgtacatgtctcaagaaaaccacaattaattcactaacatgttacaatagggagggactttttgtacccaggaaatgctttctgacaatgtttaaataaaacacctactattactttcttatgttcttaatgtccttaaataagcatcattgttccctattattcatgttgttcatttaaatgatactccgtgattcattagaaatttatattggagtacattttccgaagggattttcttaagttttcgtattaataacaaacttttcaagaccaattattggattatttttccatttccttctcatgtataataacatttctaacattccctattcatattgaagttatcaaattattgagttccattttagtcctttttcactggtttggaatatgtactttattttatcttataaatatttctctatacctctctaacaataatatggtggaaacattagcatagtttaactctgaacctacctcttccgttttccgcgttattgttgcctcatatttcattttcaccttatttcccccaaattagtccatataattgctgttgctgctgctgttgttttaactatttcatataatatttatttagatttaccgatgctattttcccagtttttgtgatcagttttgccttttgttcttccctttgcttctgtgttcagtttctttcttgctctttccttgagtgtgagtagcaaatgtgttcagattttacatattgaaaatgcctttattttgccctgagtattggataatgatgcagttgagcaggaaattatgtaaggacaggtttttttttttcctacaacactgaaaatattatttgtcttttgaaattttttgcctttaggaaatctgctgtcaagttattgtttctttatcattttctctggtacctttaaattttctcttcgtcctgtctgctctgcagtttcaccctattttgtcttctacagtttcactcaactttgtctgtgtgtaaatttgctttcatttatactttgtcacctggtgtgttaattagaacagatacgttatttctttagtggttctgcattgtctttgtgaagattttctttttcccaatctcttcattccttcctaagggaaaactttcttagagctattaagactatccccttcttatattccagttactggtttccctttaatattttctatattcttatctctatctgctcaattttggatacttttctaaaatctgtcttccaactctcaaattctcgcttcagctgcctgtggcgtaatttatccttcaatagagaaatagtctcatctttgtctgtatatatatttatctctctacatttatgtatgtgtgtttatattttttcaaaaaacatattttccatttctcaatattttattgagttgtttcacaaatctgttctttgttatggttttcttcttttttgtgattaattctatgtattcctttaaacaacttaaacagataccatctgtttgactgaaatgtttcaacttaatgagtaataaacatgacaccgtcttatttttccaataactacacccaactctgtcaaatttcaccttctgcctggtagttggcttctttaacaatatttctctgggatctcattactttttattcacttttagttattaaaatgtactctaatttaaatttaaatatcataacttaatcaaatatttcacaagtttagattaatctgttgcttcagcaatttatacagacgcaggagtgagaataaatggtctcacagtctcctcctccatcccagtttctggatacagatctactgtcgatataagggagggtgaagagggaaaaatactctcttcatgtgaaagtcctttttttgctgctcacaactgctgttcccttttgttaaaacccacacacatctataatgcctagtctgttgtccctcttctatatattatcaccactgacctggctcgttctctatagacttgattcgctctgttgaggatccagattggccttattcatatgagctttgaaccccccaaaaaagatctcctaggcttttatagtacctcgtagtgtttaacaagaatttcaagctgacgcttgtcaacagctttacacaaactgctcttgaatattatgtctttttaaccaatgctttagtgatgccctggagtctaatttacctaccatatctcaactcagagcctatgggcactggaagtacctatactccgtacctttcaggaatgagaagtttgaaagagttgtttttgattccttcttggccataccaacagctcaacaggaaatgaataccaaccaccccttcctgaatatatccacccagtagatgagtggttttgttttagatcctgtaaataaaatgattcagatgagtttaccctacctatccccataaaagggtgagaaagaagaattgcctaactattcaaactctcttcacctcactcccctcaagtctccgtcagctctctctgtttaaaccagggcttgtgaaaacaagaaagagatgatctcccaaaatgaaatgtaggcaaccaagccctttttcttaggtgtgaattccacttgccagtctcaagcaaataaactctatgggaaacatacaccatgaggctaggcatatttattgtacagttctccaaaattgttctattatctttatgtcataaggtatggattctaccatttgttacaactaatgactccctctaatggaagtgaatttccccatgtggctagtaaggtttttgtttgtttatttgtttatttgcgagctcatctataataggaattgcctttactggaatttttgtctttttttttctctgggctattgagtttttgtattgttgccatcaggattgtagagattttatgctctgccctcatgtgtgatacaagcttaagtttccgtttgttatgggtggatctttatttttcagcccaaaatcccccaacaatagtttccttgctaaatcataatattccaatggctagggatgttctacttcttccttacagggtggatggcacactgcttcattctttcccatttccctggcttgcctcatttcccatctcaagttagtgttaaatgccccagctttgatgtcgtataccctgttctgatacgccagtatttttataagcttgattttccactttctactttcatttccctctttttctttctcacacctgaggttctatatacatgttttacagatcagctatgaattaaaaatgtttcctttgtattttaacatgtattttggtataactgaagcaggatatgttgggagttacctcatcagctccatctactattttgaacagaagtttagttttttatttgtactttccttcaaagccactttggattctgtgatttcaaagtaattttaagatccaaactgttaagcttaacagttattctaagtggcttttagctccaattcgggcttcaagactatattttattttgcaaaggtgacctgtaaagctggtacattcagcctctccagctgtgtccttcagatgcattgaggacagaagaagctatccattctgacagttaaatcagcaaggtagttcattacctcaatctgcaccaaagttaataagacacattaccaatcacgtctccttgtcttcaaagctctaaggtaccctcgggtatttaagaagatatttatattttcccactgggatctttgcccagaatgaagacagcctgtagtccagcaggagctggaaatgacccagattttagatttctatcaccttttaaagcaaaacacttaatttcactttttgcaataaactgtacataagatatcaagcaggtatgaaaggttggtacgtttgccaagcaggtgagactgatacttttcatcagatagagatcgaatactctgtgtcattctaagggctatgaacatagagaactttgggaaatctgattaattttttagatccttctgaaataaatcttcctttcaagcctttaattttggtggtagtgaggcgggggcaggtggtagtaagtggtgatgattgctgcattgtgtttactgtacttataggttcattcaacagttacaaagctaacagaaaatgaccgttgttacattcttatcctctctcgcatcttcctatcttttccccaatagacataatcaccatctagaaagctacctttgttattcctttgtttaaaaaaaatccacacacatatgagtgaaaaaacaattgtgcttaatttcagtattacagtaatggtaaactataatatagtttttttagggctttgtctttcacccaacatatttgtgtctgagattcattcttatggttctttttgatgagatttttcattgtcacgtctgtattctctgtttaaagatgacggtatatttttccattctccttgcagtggacattatttccttttttttgattactacaaaaagggctgaaatgatcattgttgtaacagtcttgttatccatgttaaacagtttctctgaggatgcacatatcaaaaagtggagttgttgtcttgatgggtatgtgaatgttcaccttattgagaataacaaattgttttctgaaatggccatttcagtacacacacccaccaacaataaatacaaatttttgttcatgtatatcttctctcacacgtggaattgtcaaacttctcatttgtgtcaatcaacatggtatctcattgtaatcctggcctacatgtccttgattactaatgagattgaacatatcttcatgtttaatgtatatacatatttctctttaagattttggttcaggttttcttttcattatcgattgggttattcatcttctatttgacttgctggcatttttcatattcttatgtgttacagatgttgcagttgttttcttctattttgagtctgtttttcaattacttgatggtgtcctttgatgaatagaaggtcctaattttaatgtagtcgaatgtattcatctcttttttcttacggtcagttttttacgagatgtcttacttaagatattcttctctatgccaaagtcagaaatattttcttctatattttcttgtagaaattttaaagttctgcttttttatgagtacttctgtgtataaatcagtttcataatacaaattaatggccatttaaaataatcaaacctttgaattagtggtaatatttccgataatatacctcaaggaaataataagaatgtggaaaaatagtccatattcacgatgatgtttaccataaatttataatagcaaacaaaactaaaagtagtctatctaaaaaaaggaaattgctaaactaagatagagccactttaaagaagtcttagattttcattaaaaatatgtcttcttagtaatacagaaaatggtatgatataatgtttagtgaaaagagagctatagttaaactcacttaaattttaactatcaaattatatatgataaatttcagaggaggtcacagaatactggtaacagtgatgtgtgagggagttagatttacatatgcatttttacatatgcttttatttttctgtttcccagactgcaatgttggtgcttatttttattttaaaaagtaaattactgtcttttgaatttattcattattcatgtaataaaatgttttcttaatgacttttgattgtagaggtattagatgatgaaactgtctagctgcattttgaattacctgctacaaagtaaaggtgaaaaatacaaagtgttatattttcagaagttttaataatgaaatggcaaaatttcacatttacttttctaccataatatttaatctgtgatatatatttctttcttaggaagtttgggcatgttggcatgagttattgtcatacttggagaaagcaaacaagtggctaaatgaagtagaatttaaacttaaaaccactgaaaacattcctggcggagctgaggaaatctctgaggtgctagatgtaagttgtaaattaagccaaatgatgataatttatatgcagtattaaaagaggtcaagtaccaaatagaagacaaatccaaagaaaacaacccaagagagtataattactatgttatcactcagcactggtactttggataaagcctttgttccccctaataaccttctaggtcacaagattttgcaaagggtttaaatggcttctcacagaggaaatttgcctttattatatcactaagttctacatagatgcttcacctaattaaatgtaccacaaacctgcaaagacagtgtgaataaacaaactcactgctttagggctaatcgggatgataatatgaaatattatttccagtttaaaagctgcacgtattgaattggaacctattttatacttacttaaaatcacaaatttacaccttacggaatgttttgagttattaaatggatatgctttaatattggaaatatatctttaaagtattcataaaatgtaagtacatttttaagttttactttggagactttcaataattaaatgagtttgcatttataaacttgactttaacttctgacatttaatcattcaagctctatgcattttagtgtacttttgacttatctatatgtaatgaatatgttgttttagaatatgtaatatatgtacgtaaagctataagtagtatagcccctctgtaaatctataaaataaggagcataaattattcaagatgtgaagaaaatgtaaggtatttctttagacagaatagaatttgtaatcctagaacatcagagtagacacctatagatcattttatccaacttcctaattttcaaaaggaaattataaaacctgaaaagatattaaagtacaatgaagtagatctccagtggactttaattttggctctatctgactatgactataaatttgtcgtattcagagaagttaattgaccaaacatttcttgtgaatcagcaatgtgttacatgttctagaaaagttgcagcaaatttacagcacattaataaaaggacagtggccagaacagaagataggatgatgctgttagcctatgaaattgtcaaatcgtacatggagcaccatgctaaattcttgctctcacagtttcagtgatgtgctgaaaaactagggcatgttcacaaaggaatgttaaggaaagagagaaaatttgaagccataatgaagagcatttagaaaagatggggaaacaaaacttaccattactatttactattttagacgaggccctcacaatgcccacaacacagacaagcagggaggaggaaaattgcgagtgctcttatcttttatttctatgttgtggtcataatttcaaattgttcctaattcagataatggagccaataaatgaaattccacagtgaaaaaataaataaatacatacataaaattggctctttggtagtgttgctgatgcttatccaggaggacattttgagtgaaaagggctagatcaccacgtatcaaggatagaaaaactgcacgacttctaggttttcttgcaactcaagatatttataactgatcccttaattttgctttgttgcttttcatccacctttaaaaaaatttaacaaggtatatactttgttaagacttataaaataatgtatccattaaaattatttatatccattttgcaaataaatatttacaaaattaagatttgttagaagtaataaggaatataaattattaggaaaattattaacaatcacattgttctactcaaaaatttgatggcttttaaagtattttacaggttatagtgattttttttaatataaatgtatttaggaagtctctttattttcttgaaacttaataggacaatgtattgagtttgctcaaaattcaagaaaaatacataaacaggaaaaattacaaatatgtattggaagattttcatttttttaaaacaaggaaaacagaagatttaataaatttgtgagaacatatgcccatcacttattttatagatatgtttgaggtccagtaagatgaaattgaatcccttgttttctggcatgcctatgacactgagattcactttcatcatattatctagccaggcaactttgtcaattttgagcagtataggagatgggtattattgggatgtacgtaacagagaatcagacaacggtttaagctcacaaaatgatcttttctcaccacgaaaagaatagtgaagggaggttactcagggttgaggatggttcagccatattatgaggcgagtaggcactctctgctctctcttcctgagcatgaaggacctcacactcaaagtcattgcctcccagtgcaaagatgattgttatacctccaggccatgtatgtgcaaaaaagtaggaagggcaaaaggattcttcttgagagagtactctttttcagaattgtgtcacgtggacaccactagctatcagagaagttgagaaatttagtgttttacctcttctggttttagagttaggggacgtcaaggaaaaaggtggttgtgaatcaagttttaagttctcagtccgcaacactgtcataatcccatgaagattcatatagaatgacatcctattttttgaagcaaaaatgctccttggtgtttttaatcccaattaaaatttgctttaaattgattatgacttaattatatgtaaatcagaagatactgagcatttgctgataatccaatgtatttagaaaaaaaaggagaaatagtaattattgcaaatgtgtttcagtcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggtatgaagataagtgaaaaatctctttaatctaatttgcattaatgtatagcagatacaggcctctcagataaaatgagcaatagtttaaatattagctcagctttcaggtttcagagacaatccaatgccagacactgggtaaattctttacatgtgtattatagcatgtgatttcacaaaaacattgtaagttaggattcttaaaaggcaactgagacatcccaagaaggttactctgaccacagagttcttttccttactcaagatagaccagtatgtgtgggtatcctttctctctcgctgtctcattttattcctctccctccattccacacacatttgttatgtcacatgtaatctgctaataatacatgcaattctgttagtaccccatattatttattcttcataaataacactacatttcttatagataaattttcatatatcacacatggtgtgatttttcaaatcaaaactaaaacaaaatagcaaatttctcctagtcagtgttttgcatactatctcctaagaatggattatttgtcaagaagaaaacccattttataatgatgtttagttttatattcacttactgagtacatctactacatgtgagatatggttctatggtttgatgagtaggaaaaatttgctaaccttcataacttaaaaacattggttagttaaggaagagttactgatttcctagaatgtgcaagacataaaaacaaataatataacgtatgaagagaaaaaagagaataagggggggtagtaactagggtagtatgcatgaaaccattgactaatgacttattgaatagtcaatgtcggggaccttttgacatgcttacagattgaaaaggaacgccttgagtaggaaaacctcttctctatccaattctgaagagaagtatgtgagggtagggcagatatctgcaaatgtaccagcagcacctccagtcttgaatcctgggtggcatatccatattttatccaaatcaacataaggaattggggattggaaaaggggaattccaaacaatctctggtccttcatcattgttgcactattgctggatctgagtcaaatagatattgctatgtggcaagtaaattgaagatcatttcaatgtgggttgtgatatggaattggaatgtgtttttatttctatttgaatatcagtgtcaggtaggagacagcagttgcatcaaaaaattaaaagtcattgtgaaactgaccttggcttagctgtgaaaagactcaaatttttttttttttaaagacagggtcttgctctgtccctgagactggagtgcagtggcatgatcgtggctcactgtagcctcgacctccctgggctcaggtgatcttcccacctcagcctcctgagtagctgggactacaggtgcatgctgccactcccggttatttgtgtgtgtgtgtgtggaaatgttgttttgccatgttgtccaggctggtcttgaactcccgggctcaagctatccacttgccttggcctcccaaagtgctgggagatacacctggccaagatccaacttcagtgtttgacatttttcagtactcatctattctgtccttaggaatagcttactctctaacttgatcttggtattaactctattaatgtaattatattgcaatcctttattaacacaaaactacttataaccttctattttaaaggtttttggtataaaccctgacatttcccccaaagaaaaaataattcatttcagcaacataccctgattcaacacgtattatcttattttctggactgagtttttaaagcataaacttttgaataagaaaatacttgaaacttgggctagaataacaccttgtattagtagtcagggtccagacagggcacagaaaccactcagtcacttaaacagagatggtttaacacaaataagtattaactacttactggaaattaatttttaataggaaataaaagagatctctaaagaataccttaagcctgaggaatagtacacaaacaaggaactaatatggaaagataggagctcaacccaaggctggattcaaacttctttagaaagtgtgtgtctgcctcccatgggatgacagagaagtttccttcattgacccaatccagaacaagtctatagccagtgagctgaagctagtgtgaagagaatattggaggggaatgctgacaaaattcacagggaagtagcctatggtggggaaccattgaatttgctagaaagctgtctggtgtattcattggacatggtgggaaactacctgtagtggatgctactaaacttgaggaaatgaggtggggctccaggaagctgcctatggatttgccacccatcctcaatttgcttattgggtacccatagaacttgtcaaacacgacccatagtgttgctgaaagtcttctgggtaaagtggggtggatgaggtgagccttactgggcattccataggccagcccagagtcacaggtttgaaaaagaattaaaagcacactgggacagacaaacctctacctcccccattgtcactccagcatcctttactgacagaacttaatatcatgtcagctggcaaggggagaaatgttcccgtgtcaaaaacaggatcatgttgaaaggcaaaaaattgataactggcaaatccctctgtaattcactggctatgtgattttgagtaacagttttaaacttacgtttcctcatcctgtttcatagggggttttttttgtgagcaaaatataaaatacggcacttaaagtactatggttccaggaacacagtacatattcaataaattattcaataaatttaatacatgatcagcctttttattttgactagatgatattctagagtatcagccctcaaaaattgtgtgtgtgtgtttgtatgggtgtaaatatatatatatatatatatatgtaagtatatattaaaatatgtaaatatatatttaaaaatatgtaaatatacatatatatatatcccactgagggcagtgattggtaaataaatgcagatagtgcaatatgaaatataatgaaatgcacatgcctccattagttaaataaaatgtgaagacagataaaaaggatttttatcaccctctaagtcttaaaatcagaagctctccacttgtacctcaatgattaagcagagtgttaaaataacaataaatctaaaataagtaaacttgaaactattatcagtcctagctgtgtttatattacatatttggccagtaataacctgggagttatttgacaatgaaaataaagcatatttagtttttacggctttcatgaaaaccacatcatgttaaacataatatccttctcaaattctgttgtatcagcctgtgataagctgattagacctgaaagatacaatgttaaattaaaacaatgtgtagtaataggacttttgtatttctcaggctttgctcagcactttgatcaatttcaaactacttaggtaaaaaagacacacctaataatttattagctaaatcaatcctttggatatttccactatctagttaaaaagactgttgtttcgatgcagtagaataagccttgggataaattatctgagaggctgaagaaacaaaatgattacagtaactgagtttttaaatcaatttaaaaaattcttgttgtacattaatgtgttataatcaagaattctgaatttgttttaggccatgattctcttgatttttggttggttaaacaaaaaagtttttattttgtggttattttctatttttattttattttatttttttgagacagagtctctccctgaagcccaggctggagtgcaatggcacgatcttggctcactgcaacctctgcctcctgggttcaagcaattctcctgcctcagccagatttgctattaataaacaaagtgccttttaatttgaagatgagccttaacctattttttaaaatcaattaagtgcctatgtcagaggtttgtgaggtttttatatcacctacctaatgtttcttatagctgcaattatgcagaactaaggtaacattcaattgcctgttaaatcagtcaaacagccagacttttattgcctatgaatatttaaaagagatttgctagatcccatccctaatttcagagtgtgagtttgcattcaaataagtaataaattatttccatcacttcaaaaggcatctttcattcttgataatcatatagcactatattttctactcacagtaatgatttgaaagatggttagcaaaccaggcaacatctccaacagacgtaccaaatcatatcatttttacaactattgtaatagctttattctctaacagggtaaccaagcagcagaagatgatttagtaatacaacaaaatgaataataatattggtaatagtatttggttacagaggctcaggtacccttttaattgtcagatatgcattttctcatttagttctcacaatagccttatgatacatggtggtttttgtttttgttttttctttttttgagatggagtctttccctgttgcccaggctagagtacaagggtgcaatctcagctcactgcaacctcctcctcccgggttcaagcgattatcttgcctcagcctcccgagtagctgggattactggcacatgccactacgccaggctaatttttgtatttttagtagagatggagcttcaccatgttggccaggctggcctcaaacacctgacctcaggttatccgcccgcctcggcctcccaaagtgcttgaattacaggcgtgagccaccgcatccggccgatatatggtttttcatattcccattctacagaaattgaaaggatattaaaggccctaggaaaaagctattgagcatttagacccatctctttacacttgaagcctaggcacgtgaccatttggctacactacctccaatctctgtgacccttttcatatattaaaaataaaaactctgctaataagtgaatatggcaattaacgagtttccccgtttttaaggaaagcttaaaacatggccttaaaagtattatggctgactaattaaaataaaatttagagtcttaaatattaaagtcacacattgagaagtccaaagcctttaccacttctcttgatgagtgattatttcacctctttcgtggcttattaatgcccgtatttcagtccctttcaaagatgtctgtaagttgttatgcctgacatgaaatagcaaatttactgaaagggacaaaatctaaattggttaattcttctgtaatagtaacatttatgatagactcagagagggccgtattaatttttcctggtaattatgactttgaatttttccctcagtgtcacatctaccttagcatagatagaccagaacggaagaacattgcttgaaggaagactataaagtaatctaggaaaataagtggcatattatgctttattaatttgtcaatatgttttgtagacaatatctgtctataataatagtaaaagccattactttttgagcacagttttacgtcagtccttttgctaagccgttagaagcaacatcaaacttaaatcccacatttgctttatgaaatagatttgattagcttacttcacagttgttgtgatagggctgacttctgttctcaagggctaggacagctaagtcttctgtaatgccctctggaaagcactaggatgctggaaaatgtctagtagttgtattttatgttgctttcaaagaagtataagtaaacctttaaaggctaggaaaaaaatcagatgaaactgaagtcatgccgtaacatgcctatgaccactgacatttgtatggtggagataaaagctaagactgggaaccccaattttaggtgaattaagtcatttgatggaaaagaaatatgatcctctggctcacgaaaatggtggagctaaacacagattccacataaaactggggttctatcagtaagataatgggcagagagaattctatctgcagagagaacaaacataaaaagacatctgtcttctcactgtgagtgcaaagtaatagaataattataataatgtcacctgaaaatgtgtgttggcctattcttgtaaggtgaggaactcttgagtgtatattatcacaaagggtaaagaaatatccaaacaagtgattaagtcagggtagcaccaggttaggagcgtcctagcattagttagaagcaaatgcaaattgtttaccatgaaaagtgccctcagtgtcctcacagattaaactcaggggaacttgagctcatcataaacacatagacatacacacactcactcacacgcacaagaaaagccctcatgaagcacagtcagcctatacaacgaacggtgagtttacttctagaattccggatattagaattgcaagatgtatagtataaaataaataggtaaaatattatagaaataaatgttattgaagttataaaaaagaaaacattgtaaaaatggaataaagaaatcaaaattaaacaactacaattaaaaattagaaaatgaatatatcatatataaacatattagttgaaagaaatgatttaaaagaaaactaaaagagaatgtacagactgtgttaccaaaaactaaggaggtggaagatgtgaacaataggtaatagatacaggggtggggagtagaatatgaacatataacttatctcaatgggagttttcaaagaggagaataaagaaaatggagattattattattcaatataaaaaaattatataacccaatttaaaaatgagcagttgagctcaaaaggcatttcttcaatgaagacctacatatggccaacatatatatgaaaaggtgctcaaactcattaatcatcagggctatgtaaatcaaaaccacaatgatatatgtcttcacatctgttagaatggcagttacttaaaaagaaaatcaagagatgacaagtttggcaagaatgtggagaaaagggccccttgtaccctgatggcaggaatgttaattcatgctgacactatggaaaacagtatggagattcctcaaaaaaaaaattaaaaatagaattactatatgatccagcaattccacttctagggatatatccaaaggaaattgaatgagaatcacaaggagattatctgcactctattgtttattgcagcattatttacaatagcaaagatatagagacaacctaaatgtccattgacaggtgaaaggaaaaagaaaatgtgatatatacatacaatgaaatattattcagcccttaaaaaataagcaaatcctaccatttcgctgtaacaacatggataaacctggaggacattatgctacatgaagtaagccagacatagaaagacaaataatacatgatcccaatcatattatgaatctaatacagtcaaactaatggaaggagaatgtggaatgcttcctgccaggggctaggggaagggaaaaatggagagatatttgtaaaagggtacaatgtttaggttatacaatatagataattcctagagatctactgtaaagcatattgcctatagttagtctatttacttaaactttgctaagaggatagaccttatgttaagtgttctgttacagaataataataatattagaataggaggaaagttttggagatgatgaataggtttatgtcatagattgaggtaatgtttttatcagtgtatatttatctccaaactcagcaacttgtgtatgttaattatatacagctttcttgtatgtcataatttttttgagaaatggagatggagtaatatatgaaggatattaaaggaaagtttccaagagccagtgacataaaccacttaaacagaaagcacattatataacaggcaaagtaaataaatagaaatccaatctcagacatatcacagtgaaagtgcagaaatccaaagacaaatttatattagcagctagaggtgagatggataacctacaaagcaattaaatttaggctgtcattagacttcttatctacaacaatgaataagaataaaaaagcaatggaaaatattttcaagatattgaaaaaattaccgtcaacctagaattctgaactcaacaaaattagttcttcagagtaagaggaaattagacattatcagagtgaaaaaaaagtgaaattttaccccaatagacccttactataaaaatgtctaaaataagtatgaagaattagaagtagtagaaaaataagttttaaaggttttagatgcaataagtatgatgaaaaaatagttaagcttttaaatacaaaaggcatttgttgcaaaaaatatataagaatatctaatttcatttaaaataatgttgatctaaaatactagattaaaaacaatatggaggggagttacagccacaagcccttttatttagaaagagggtagagatagtgattaaatgtcgactttatgctgtaataaattgtcaaggataaccactaatggagcatccacctgggaaacaatcaaagaatgataaaaggaacagttctcaatcagtacgcagtaaagcaagaaagaaggaaaacaaaacagaaaaatgtgagatgagcataaaataaaagaaaagatggtagaaaaatagaaatagaaaaaaatagatggtagaaaaataccagcggccgggcgtggtagctcatgccttaatcccagcactttgggaggccaaggcaggcagaccaggctgccaacaaggtgatacctggtctctaccacaaatacaaaaaaaaaaaaaaaaaaaaaaaacccaaaaaaaagtatccaggcttggtggtgggtgcctataatcccaactactcgggaggctgagacaggagaatcacttgaacccagggaacggaagttgcagtgagctgagatcatgccatttcactccagactgggtgaaagagcaaaactctgcctcaaaaaaaaaaaaaaaaaaggaaagaaaagaaaaagaaaaaaaaaatacatctgtagtcctagaactatttgctcaatacatttaatatataaatgtagaaattttcagaataaagcatcaaaattcaaaatacattgtttttaagaaatacataaagacacatatatcgaaaatggaaacagattttccgaaaaggattaatcaataaaaagcttagacacctaatttatttccagcaaaatagacattatggtcattatcattattaggcaaaaaatggagtaaaatataacagttctaaaacttgtacatacctggccgggcatggtggctcacgcctctaatcccagcactttgagaggccgaggtgggtggctcacctgaggtcaggagttcgagaccaatctgggcagcatggtgaaaccccgtctctgctaaaaatacaaaaattaaccagctgtggtggtgcacgcctgtagtcccagctgcttgggaggctgaggtgggagaattgcttgaatctgggaggcagaggttgcagtgagctgagattgcagtctccactccagcctgggttacggagtgagactctgtcaaaagaaacaaaaaaatctcgtacatacctgggaaaatacctttaaaacacgtaaagcaaaaatccacagaataacaagaagaaatacacaactatatcagcatggtgggagatttcataatgcctctttctttcaagacaccagacaaaagttagtgaagatagtgatgattaacagttgataaggtggatataaagactgtatagagaaccccaaatcagagtgtaaatttcatctgaagtacatggaaatgtcaatacatttcacatatttggtattattagggaaatactcttaaatttgtaacaagctagaatcaatagtaaaaacttgactaaagtaaataatttgtggatcaaagatgaattcaaaatggatggttaaaattcatagaaccgagtgataataaaaataaaaattaaaactaattggttcctgttaatttttgtagaagagacggaagggctgaaaactagtgagctaactgcccatctcaagaaaatagggaaaagtataataaatgcagagaaagtaaatggaaagagaagaattcaagagcagaaataaataaaaacaacatggaatcaataaaatttaaatgcccatattcatgttttaattagacaaatcaactgagagggaagtaaaaacaaatataaaatcttaaggatgaaaatgttataactacagttataatatatttttaaaatacagaaaatactaaaagctatgcaaataagtttagaaacttacatgaaatggatgaatttctaggagaatattgctacaaaaatgatggaaggggatatagaaagcctgaggagacagaaatttaatcacaaattaaaagtcttcctacaaagactatattagactgaaattattttacattcaaatttgaacacactttctaggaatagataattccagtcatcaacaaactcagtagaacatacaaggcaatatacatgtctggaaaatataaggttagaaaatttttttttttttttaccaaaatcagacaaaaatgaaacaggaaggaaaaccccatgccaatttcagtcataaattaataaggaaaagttctgaaacaaattattggccaactggatccaagtgtgtatgaaacagtgtttaagcttaatgttctccctttcctttctatattcactctttataatactttatgcagtgtcatggctttaaataaaatttacatgctaattattcccaaaatattatctctggcacagacttttgcccttaacttcagaccatatatccagccttctattgtgtatttttctctttggatatctcataggctactcaaacttaacatactcagatgacagctcctatcaaagctacccaacaccgttttctccacctctgttaatgccatctcattcctgaaatttctcataccaaaacttttaaaatgaactttgattcttgtctttctttaccagcctttctcttagcagatctgaaagatggtctcaacagatctagctgttgttttacttttatgttctgggtatatatgcaggtttgttatacaggtaaacagtgtgtcatggggggttggtgtacagattatttcatcacccaggtaataagcatactacctgataggtattttttctgatcctccccttcctcccattctctatcctcaagtaggacccagtgtctgttccctcattgtgtccatgtattctcattatttagctcccacttataagtgagaacatgtgatatttagttgtctgttcctgcattagtttgctaagtagaatggtctccagctccctccatgttcctgcaaaggacacgaactccttctttttgtggctgcgtagtgttccatggtgtatatgcaccacattttctttatctagtctaccatggagggcatttaggttgattctgtatctttgctattgtgaatagtgttgcaatgaacatatgtgtgcatgtgtctttgtggtagaacaatttgtattcctttggctatacacccggtaatggggttgctgtgttctgtttttagctctgccaaactgctttccacaagggctcaactaatttacacccccaccagcagtgtataaatgttctgttttctctgccatcccaacagcatctgttattttttgacattttaataatagccattttgactggtgcgagatggcatcttatcgtggttttaatgtgcacttctctaatggttggtgatattgagcattttttttcatattgttggccacatgtgtgtcgtcttgtgaaaaatgtgtgttcatgtcctttgcccatttttaatggagtagagtttttaaaataaatttgtttaagttacttagagattctggatgttaaacctttatcagattcacagtttgcaaaatatttctcccgttctgtagtttgtctgtttactctgttgacagagttcaacagaggaactctgtgaggaagttgtgtaatttaattaggtctcatttgtcagtgtttgcttttgttgcaattgcttttgacatcatcattacatcttttcccattcctatgtccaggatggtattgcctaggttatcctccagggtttttaaagttttgctttgacattttaagtctttcattcatcttgagttgatttttgtatatggtgtaaggttttattcttctgtatacggttagccagttatcccagcaccatttatggaatagggagtcctttcctcattgcttgcttttgtcggctttgtcgaagatcagaagggtataggtgtgtggcattatttctgggctttccattctgtttcattggtctatgtgactgtttttgtaccagtactgtgttgttttggttactgtagcactgtagtatagtttgaagtcagctaacatgatgcctccactagctgtatttctttgctccttctctcattaaatatagtctctgtgttccaaagtgaggaggaacaactgtgagattaagatttggtaaaagagaaaatgagcagggcaaatagagacaataaatctgtgatgatgaaaaaatgagaaagaaaggccagtaactgaaattgaatagtaatagggcagaaaagatgtgttgttgattttcaggataataaaaatttaagcatgtttgtagtataagggaagatccaatagaaagacataatatataagagcaaagtcttacaagataggatacacgagcaaaaaaaatggaaggattgactttggaagtgggaaagagaaaattgagataatacaaggaggttctgaggtggagagtagtaagtttgagaaagtttatccaccaaggataaatttatccctgagaagtaggtaactctgttttcaggttgtttaggactctgcacggtaaagggggttgggagaaaggagaactggtgtcattgaggaaatgagagtgaaaagtatttggaataggagctcttttgttttaaagattcgtttaaaatcaggagaagtgttagagaataatatcgtggactcagtagtagccaatgaagttattcgcaatggaaataatcagttatctgactttctcccgtaattttctgcaaaataattttatttagaaccacacacatacagccgcatagaaaatcaaaagcgaagggatttttctttgcgttatctttgattagcatctccaggttgtatttgattatattctgaaacaactaggattctagtctgaagtatcttcttccaactatattcatatttgcaagtcattcatctggttaccgccagtatgtcaaatgtgaatttcatgtatttttttttttttttttacaatctctctaacttaaccaatttaattcagatttttatgtcagtcttttagctgttggctgtttttcccaaaatgtcaggatcggctccataatttgggggactcagggaagaaagaaaatactgggtcccatactcaaaaattaagcattgtaagatggcaacagcagagcattaaaccaagcatgggctctcctaagcatgagttactgcataactgcacaggttgcatggctttgaagccaatttcgggtgtcatcttatacatttggttatttgtacacctgaaatgcttttgataaggtttgggagttaacaatttaggctcacttttatagattatcattacttgaaaatatttcattgaggataattaattaacaataaatgctttaatatttagaaaggtgaaatttaatcttattcttagtgtgttaataatggatatagcttctaggtttacatctttccatactttgaattcagggctttctttccttaagtagtaaaaaggatattggatatcttgaatcttgacttctcctaggttgaatgctctgcaaaaaacctttgtctttatataaaaattgcactgcaagcagactattatggcagacctctgtgttcaaggtgactgcaattttcagctgagtggtggactatgcaacttgttctcataataatattaattgaataaatggtcaagagtgattacattttgaggggaagaaacccacttgtgtaatatttacacatagataataaactcaatagcccagacctctttaatgtaagaaaaatagacatgaatgtgtatgctattttctttgtaaattagaaatttttccttctctatttcatgtatcttcttttgttatttgagaaagggatttttcttgtcctaccatcaattgtgtgagttaccttgattcttgtttttaataatattttaaaatacatcttgtattttaaatgtagttaccctctattttatagctacaggaactgaaagagtacatagccttcacaaaagggtctgtggtgaatgtgtttaattcttattttaatcaccatgaatcatggattttttctttgtaagtagtaattccattatttttagatataatttaccctacttcaatcaataatgtttccttggacagtcatatttacttttccgaaatattatataaaacagtagttaaatgtttttgttcgtctgtatgcctattatagaatattagcatttttggggtccagacacaaagggacacacaaacacatatatatacttgcatgtatttatatatacatgtatataagcacatatgtatacatataatcatgtactgcatttcaatatatgattaatatttaagtatttaatattcactctagacaaattatgtttgctcttggagggcattaatatctttgtgaatgagtgttaacatatccatttaatggtatcttgtcttcaaatatctcataatttgatagttgagttatttcttctgaagttggaatagcttttctacaagggcctaccaaaaaaaaaaaaaaagaataataaagttggaataacaaaagagggagttaatacataaaggaaaaccattaaggccgaaaaactaatcagttgtaaaagctaaatcagtagtatggattgataaagtagcattttagtgataaatttttggattgaagtttctcttttaagtttatcaatgtaccttttcagaaaaattcctcgagtttatatctttatgttaatgaaacttgtcaataactttaattatctatgatgattgacaactaatacttaatttctataacacacaatactgttctgagggtacatattcatctctctctttcatcttacgttttaccactctcaactttttaaaaccgttttctttgcaagctacttcatagattcttgagattgaataatcaaatctgttatttaatattcaggccaaatttctgaaaatgtttatttttttaaaaaaaatgataaatggaaaagggaatgttaaacaacatttctttgcagtgtattccagtgtccctagatggaatgaggaataaaaatatttttcaagttcatcatgctgtcttttaaatcataaaatgcatatatttattagtaatttttcattgaaagtatcaaagaaaattggagaatttccttactgtttctacctcactatgtttcgtatattctgaccagcattaataccaatttcatagcactctactgttcgctcttttttgctgtaagcccaactgattgcattttcttacctgttatttttcgttgttgttatttaagacatcttttctttctaacttcggtcttcatagaccttctcaatttcagctcatcaccaaaattacacagatagaagaatatagggactttggtgtacacatacccacttttgactccctctgattttctaatttagtagattttaattgaggctgagaactgtatttggaaaagttcattctgatgattattcaggtttgtgaaccccagtctagatagacctttatcagcacatgtataaggtgcactttgctaaggtgcattatgtgtcaggttcattcccactgtggaccagtaatttattcttgcccaaccactgctcatgacagatagatgatctctgtattccagaaatgaagctcctttccaattcctcaacaactaaaccaagcagaggaaaaagtggttttccttcacagccatagttccctgctgaagtagaatgaacgctttctaggaaactgcagcagatttttgatgacacggaaagggcatcactaggatcctcattatatattacctctctccctcacccgaaccacaatgttgacggaacagatacttcctgtggggaagatgctaagcagtcctgcatggctgtaggcattgtccacatcttaatcttcagctatatctgaggtatgacaagtttaacaatcctacaagttaaagcgtcacaccggaaacctgtttattcttctcccatgccaaataattccagcacgatgggtttcatctatagacgatgagaagatgccattgtggggtgaggacatagagaagagaggaagtttggaaccagtttatttctatttcagcaagcttaatgtattgtaagaacattttgtggcagatgaccctagtctgtaacaaggaatcgattgtaatgcatcattctgccagtgtttatctgttccctatgctcatataaacacacgagtcatctttctgcactcccaacctactcctaaagcactatacagaatgtttcgaaagcagaaggaaaagcagctgttccatacaccatgttcctgctgttcaaggtgcacatcccatccaaatgaatcatatcagagccaaagatcctggtaggagttcttttctacaaaactgcagtcttgtctatcctaacaacttggaggacaaaatattagaaaaccttgtaataaccttaggacacaataatgtagatactgactgagctagacctgaggactttttcaatgtagtgtggataagtaagatgacaggaagccataagcatactgtgccttgcacatcaacttctccagagccatgacaatcatctggagtatttgtgataaataaatattgttaatcttcatgtaattgggtaggatgaaaaaggaccagtcgtcccagacatcccaggagagaggagcatttttccagttgctcagatacaatttcaagttcgaaccaatatgaattacagttgaccacagaggccggcaaaatccatggcactgtagtccaagagaacctgaacactggccttagagtattatgagcctacatcacagtagaaggaatccagcagagatctctaatgcacatcagaaaagcaccatttctagttatcaaggctgtatttcacactgcttgactgaagattggaaactattttattcataggcaacctgtgtggccatccttacctggtctataaaaggaagtgtgatgaatttgcttcccatacatcatattaagtccagaaagccagagatgctgtgttgagtttctttcctgagagtctgaattcctaagtagagggactaacgagttccaaagttctttcactctgagatctttgtcacactactgtactgactggatatcactgaccttatttaagaggactatcaactggctagttcatctacattgtaaggactagtttgctcacaaccaccaacctatctgtaattggcctcagtatgctctctctcacttgggtacttctgtatttggctaattaacctataccacttggcttagaagcaccagctacattttttctaattttgacttctcatcttttccaacttgattttatccccagatttggacttttgtctcatgtataaactttatattttgcttgaacatgtggtctcaatgctgaccaagtcatccctagaatctgattctgtctcactattccatatcaggagacagcgacttaaatattttaattatttcctgtatcaataaattattcactgcctaaagtttagactttaataatatgaacacatgtgcagtcaaagagtacctcgccattgggccggaaaaatttcactgacttagggtggctcctgaaggtaccttgagaaagcttggatatgatgaatcctgtagacttattttatgtttactgaataatgcttcattcactttctttttgaagcttaaataaagcatcagtttgctcctgtcagggcagaagaccaatttcacttgtctacccatgaggataaatggatgcagcaagaatccagaaatgtcttagatatattactctatagctcattgaccattctatcaatgctcaatgctttacttgaaagtgatggctatctgatgtcaagttccattgataaaatgattcccaaacgttactttcaagtatgcttccttcagaggtcacagaagaacttcagtaacctgctaaaacctaaaacaggtgaagttcctattaaccatgacaccaagagttttcacatttatattctttcctggtaaagaaaattataggagctccatgctcacggcttttgagttttctcccaggtgtgttcaaacctagtgacattaacaaaacataaatctagaagcctttcgtgaataatgtaaccttctttattttatatttaaaggatatatatgcagacatgtacacatctttgtaattatttaccgcctatatccctattaaatacattaacaaatatgccacaggaaaaaccactgtaccaaagcccctcacaagagttatatttaaagtgggttaaagcaacatggttttaatttacttagtctttcttgtccaaggaacacagtgtgagacctcctttctttaggaaaaaataggatgaactaatttgaaaacaaagaaagcaacaaagtgaatcttgtgatgagctatgagcattggtaaattatttcttctgttgtaaattatcctcttctccctctgcttttctcttaatctccatttaattcccttttcaaaatcctaactctattctttttggaaaacatttcattaagctggtataagcatatctagacatctggaaatttttgtataacttttaaaggatctattacttaacaccatatgaaattatggaaaataaagtgttcctatctaatcaatctcaaagatttttcaagtgtacaatacaatgtgtgcttcaagtgtcagcttcttttttttttttttttttttttttttgagacagagtctcactctgtcacccagactgtagtgcaatggcacgatctcagctcactgccagctctacctcccgggttcacaccattctcctgcctcagcctcctgcgtagctgggactacaggcgcctgccaccatgccaggctaattttttgtatttttagtagaaacagggtttcaccgtgtcagccaggatggtttcgatctcctgaagtgtcaacttctttaaggctgtcatcttgccggttctaaacaactaaaaattgtaagaaccaatttctgagacaaatagaacattcttagtggtccttaaataattcctgatacttttatggcatgcttctttaaagaccttagaattatgcttcaggaatttaaattggttgttcagcaaagttaccaatcagtaggcaagttgttgcatttgacaggagcaatagttttcacgtggattatttatattcatgtatgttggtagacggatataaaacatgcaacttgcagttgcatgagacaaaagcatcaacatatctatcttagcttttcaatcatgtgatactactataatgctccatttttcacagatatttcttaagttctttatctcttcagacctcccgtaaaccattttctgtcttctgctggaccacattctagatgatctggatgtctatcattctcctttgcctttgctttatttgagtaagtgctgaattcgtggactgtgttagtagtttgatgcgtagtttcagccagatagatcagaaacatgaaatgcttttacatcatccaggtagatggcgccatgaatagatccctttgctttctggcctctgaggtaataaagacttaaatctaattgggttcagcttaaaatctcaatgtcatatttaatttaatatgcttccttgtttccagctcaagcttaagccatggtctaaaagactttctctggaaggcaagtgtggttagattccatcttacacctccactgcctctttttcttttttttttttttaactgcacttcagttatattattctccaatgtcttgggaagtaggagttaaggaaaataggcaaatgtctcctgttaactagctatttgtagctttgagtttatgatttgtgtgtgtgtgtgtgtgtgtgtaacagagatacaaagttcgggtttatttggggtacaagtatgggatctttaagaagtcttgcagaagctcttttgttttccccatctttaagaaggaaaatatgctctataaaaacatcttcaagcctcttgatcctgaggtactcttgctccataaagagtgttcctggtagatagctcaaacatggctgtcttcttccacgttcacttgacctattgagaaacgtttgccacaccaagcactggggagtacaggctgccccccttcttcactgtatcatttctcattcattttttacctatcaagtaggcatataatttctgaagcagacatcttcagaagcagagttggtaattaggtgtcatccctatctactctggactcccagaccctgtgatcagtggtcttggagctccacttacttgcatgggacaaaaaggttgaagtaccatcttcttttcccccttacggaataaacagagggagccatccctactctccctctgggccatgaattcagaagaccgattctttctaaaaccttcagagagttttagtataagtgggtatggtggagcaacaaaggcagggccagttttcccagctcttttgtaagccctttgctatgccctgctatttccatctcttagaatgagagagacttattacttgttattttcagtttaagactatacccaaaattctaagacaacagatagaattcaatgcattcatatccatagtgacagtttcacacttgctcttaagttaaatagaagagttaggtcaggaggaaatagtttatcaaaaatgatatacacccaccagtattcttagtacttggcacttgaacaaattgcaacctgttagtaggtaaaaaagaaacactaaaaggaaatagttggaccactgaactattgcttgatccactgaagcaagtgttgcttggtccactgaagttgagactctgggaaagaaaacttgactggtaaactctgtgaagtgaagcgtggttgtcaaatggagattaatgtcctctcatgggtctccactgtagtttctgaagggcaggttgagtaggatttggttttagcacatctcttgcaggactcctatcccaagacactttctataaaataaaacatattccatattgctctactttctgcaaggtacggacagtcaggttggggccaattaatgcactaccctaagcagaaacttcaagactttgtcgttgctttgctttatttgaattggaatttgggatttagttttcgttagttcatttactactaaaatcactcataaaaatgagggctttattttgacattggcaaaaatccttctttactcagaagaaaatatttaaaactgctggaaattgaaatgttttacatgtctacatcacaatgatgaatacaatgatgagtatttaaacaccaaaaataaaagtgtcttattacgagatgattgtaaacagtgcacccacattcttaatccatttgcaagcataagcttacccatcacctcataaatgcagtaaaattgctttttgtattgagtttaataagtatagtataggatacctagctcctttaatgaatgtgttttttgtaaaatattattaaatgattttttttctaatttggctttttaaagcatgcattcatatgttaaatacattttttggtttcaatattcggttttttatttcacatgcagagttttctcttccagagtttcttagacatgctacactttgatttatgtgtttgtaatattgtggtacaaaggttagtacattatttttaaaatggaaatgtgagaaactgtcaattcattgtagagatgactttacattgccagcaaaactcattaaactcttaaaactttttcttaaacttattttatatttccatagtactttaaagatataaaataattaatttgtgttaacttttacttagttttaattttcattgaaaactgggttaaaatatattatgtgtttttcttggtaaccattactaggattgttttctatttttatatttttgtcattgatcgccagttattaaaagatgtctttctaactttccttatatttgctgtttctgtctagctatataattcctcttactgctaagtggattagctaaagacatgaaataacattttaaaacaacagcggaacagtattctggaacaacaacaaaaaatcagattatggttgaagactttctacaaacttcattcaatgagacagcacaggtcaagcgggcagaaagtcagaaaattcataagcctgacattccatcagggtgcgcctaatcagatgtttagaaatagaaggcagcttatgccatgactagttgaaagaattctgcaagcttgcattgacatgaggtcttttcaatgactgagataatcaaggaatctgtgtaaatcagcctctcttattgactgtcaggccaggaaaagagccaacccacccgaagtcaactctgccatcatttcttaagccacactgttcctttcagctcatagaatctcatgaatagaaaaagttaggtttctaaaaagaattttgaggctagatatgtggtttaatgttattctatattacatcctatacaattaaaatctacagatgtgccttgtagagtacactgtttttgcctttagccagaggaaggaccaaatttaatacctggctaggcaattattacacgctgtgattggaagttttctccaaccacctgtcacaatgctgaaattttatcactagagatccatttctttggaagagctgtgggtaggctgcagccagtctcctctgcaatagaggctctgattatagccctgaacactgttatctgaaatagtaaattacctgatgtaaattttagttgaaattttgactgagaacaaaaggaagctatgtttgaattggaatatagggcaaagcctcggtcaccaatcttggatacagaattttaatagaaagagattaaaattttctccaaataatgtcccacccccattctgacacttttaatacaaaaacagatagatttattgtccaaaagatacatctctgagcagtggtgacctttgtttacaatttcttctgtaaatccattttcgtctttgactatttaaagttttctgtttttctcattaaaatttctccttatacttttcacccagtcataaataaagctattgggcttcattctaggaactggtattgagcaatgaacaggacagccgtaatccttgaactcattagagttgatagtctaaagtaaatgcagaccattaatgggagattaaatatgttatggcacatacaaagtgcaagaaagaacataatgtcatgtgagggaatgcataaatagcttaatttagccatcccgtaacatattcatatattaaaacatcatgttacgtgctctaacttgatagaatttttacttgtcaaatcaaaaaaatacaaaattcaaagaacatgcaagaattacctccctgaacttagaaggtgccagaggtagccacttggaagagatgtccactacattaagaagataaatgtaaattagccaataaaaggaagtcagaattgagattatgccagtaaaagggaacaacatgtttaaggccaagaatcaagagggccacagtgtaggttgggaaataaaaaataaaatttctgtatagctagagcagggagtaaaagacaccagcaggacttatattatgaagggacttttaagccacattaaggataaagcttttggctgcgcgcaatgtctcacgcctataatcccagcacttagggaggccgaggtgggtggatcatcttaggtcaggagtttgagaccagcctgggcaaattggtgaaaccctgtctctactaaaaatacaaaaattcgccaggcatggtggcaggtacctgtaatcccagctacttgagaggctgaggcaggagaatcacttgaaccagggaggcagaggttgcagtgagcagagattgtgccactgcactccagtctgggtgacagagagagactccgcctccatctcaaaaaaaaaaaaaaaaaaaaaagaatagagcttttatttgaaggacagtaaagaatcactagagaattttagacaggaagccccaattcgttattgagagaacacattgcagctgctttacaggtgggatgtggcagagtaaaatgccagtgaagaaactgatagcatatttgaggtaagatatagtaatgattttaactagagtaaagacaatggagagagagagaaaagattggaatcaagaactatttagaaggtataataaataattagtgattgactgattagatgcaacatgatgaaggacatgatagaggaagtagaaatatctagaattacatctaataaagggaatcattatttgtttttcgctgaaaccggaaaaaatacagagaaggaggaaaagcaagttggggagttgagaagtaggtgagaagagtatatgcaaggagttcatgtgtgggagtgttagcttttggtggttgcagaatattcatgaggagatgtccaatagggtgagataacatgcaagtatggagatcaaggggagatctggacttgagagatgtagagttgagagttgtcagaatgtgaggaggaattgaagttaaggtatgggtagaatgagaagaaaggaaagcccaggataaaatcttaatggagtcaaaatttatggtacagggagaagtactgggaaagccttccctcttcctgcagcatcactaaacttcctgttcttttgccttagtctagatgcctttaactgtagttttacttgggcaaagctgtgttataggctggcttcactgaagaataatgacatcactaatatttttaaagcttaaaaagtatagtatttatgtaatatctaatattctatatataatataaaaaccaagatcatcttaaaacctcagtcatgctctgtgggaaagaaagttatattgtacctgataatcatgcctttacattgtatattaaggaaatgtattttaaatgacacataatgaattcccaataagttgcctgccctatttcttacttttacaactactctgttaaaagtgaacagatccttgaagggagactttccaatctgtgcagcatggtatttatacttgaacattattgaattatcctaatcatacttatagttacaatcaagattaattgcagctatattaggattacttattattttttctacttcagcagtaacataaacccaattgtacaaacaatttctgtaatccaaattgtgaaagaaagtagggagaaaaaagatcatgcaaagctggttgaaatagtattcaaaataaatctttaaccagactgttatctaaaattctgtttttgacaaggagctgattctgaacagattgtacatgtatctcactggtggaagcagattatctgtcttgaattggattgtgatgacgatgaccctattctaagcaaaccaaatctcttgaactatataatgagatcaggaggaacattcgacctgagaaagacagattgcaatgactgagatgattttgctaattttttttccagcctatttccttaatgtacgtgatattgtgattgattttcatgcagagatccctgatcctatagttttgtttgctatttatttttctccttcacattttttttctatcaacagagctgaatgagtgccaggaagctgcgaaatctgtcttacaaaaaggtgattgtggaagagtctagaatcttcatttattgttcagcaggattacagaaaagctatcaagagtaaacatttaactgatacactcttattccttctttttaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccaggcaagtacatctgggaatcagcttccattcttttgtttttattacttcaacaaaatgttgcagtgtttctaactttaaatttattcaactagttttccatggggttgttttgattcactgatttgactatttggaggtaggtaggaagaaaagggggtctagatcattagtctaagatttatttttttaaggatgtaatggaggaatttgaaataaagacatttcaaagacaggagcaatacgttctggtgtttctgacttcaaactatactaaaagctagagtaaaaccataggatagtaaatggtaaagaaaatgttttttggccgggtgtggtggctcacacctgtaatcccagccctttgggatgctgaggcccacgaatcacaatgtcaggagttcaagaccagcctggccaacatggtgaaaccctgtctctactaaaaatacaaaaattagccaggtttgttggcacgcgcctgtaatcccagctactcgggaggctgaggcaggagaatcacttgaacacgggaggcggaggttgcagtgagccgagattgcaccactgtactccagcctggaacagagcgagactctatcttataaaaagaaaaaaagaaaatattttctatggcattgttggaaagcagtctcaaacattttattataaactcctcgtttagtcacatggtctatattgttttataaaaatgtgttagttacaagcagtgagtaacacaaaattatcgatataaatttacacctcaattattaatgatcatgctcaatatagctacatgcactcactcccatgcttcattcaaacgaaaatataaaacgtgtttacctgtttttctagaatgagaattaaaatagtgttgaaaataaatctgagttgacttttaaatgagtaaattttaggccataactaaatttacattcactgtaagaagtatttttaaaatgctgttctcattttttaattaacatttaaacatatgtgaagttatcataggtattatttattcaaaagtctttagggttgtgtgatcgcaattactagatctgcttttcaaatcttatatacatgttgtgaacccaatcaccaagtccatgctatgatgagaggagcactagaaggttagctgcaaatctcaaagccttctccctgccagttggtgaagatgtctgaagtttttcactttaaaatgaatttgggggtgatatattagatttgtagatcatggttacaatgcaattacagttaatgaatcaccgttaataggtgttctgggcaacagtatacacaatagcatgagttaatttaccatattgtctaactttgaccaagaatgtccctgataatatgtggcagagtataggtagttttgataggcttaaaaagtccagggaatattatttccttatggagtgcatacaattgcaatagtggatgaagaaagagaattttggggagaatcctgatgataaaatcctcatcatagttttccactgggcaacaagagtaaatattgtagtagaagtgagggataatagtaaacatacttgaggattcaatttttaatttgtcttgatatataatgattgtacatattttagagggtaagtgtgataggtttatacaaacctactccagtatatatatttttcaaacttacacaagccaggttctctagaattaactattcctaagtccgtcccagtttgagtcataatgaaaaaggttttttgatataaaatatttatacatatttatggatacaacatttatgtaatattttcttacatgtatagaaagtgtaatgatcaagtcagggtatttagtgtgtctaccacggcagggtttagtaaaatgcatgataggaatgagtaattgtttctgaattgagaagaactacatgactataaatgaaatacagagtagaactgctttcatttaaactaatgacatgagttttgaaggaatgtttgattaaaaatgcttgtgacgttctgaatggaattaaggaaaaatttgagcagtatgaatactagacattaatattgcaagtttgtacttcaaaatgcataaagaattactttgtgacagacttgcggaatgaaattatgagtagcaaatttgataggcaaagctattatactattgtctttcaaggaaaattggagcttttagggcgaagcatctttagttgaacaggttgtgataaggggcactgtgtgttttttcttatttagaaatggattcaggattttataaacattacttgtttttaatagcaaaatattttgcttggtttttctaaaaaaatactacaataaaaatgttattaactacatcagtagaaaagtactagtaaacagcagaacacagataaattatgaaatttcagatctacttcaagaaagagattttgggcattcagatcaaatctattttccatgcatttcaggtcacacctgcattatcaacatagttcttgacattgagtctccccaatggtaatacataatattggagaatacaagccatctgaaagctcttaaaacattcttctgctccagggttttattttaatatggcagtaagtgaattgttttctagaacagagttctcaggtactcagatttgcttcaaggattatatttcctgaaaagcagctcgaaattcccatgaaataaaatagagagtcaaaagttagatagtgaaataacataagcacagtgtgtaagatgaaggatccactaagaatgccaccaaaatgacattttaaatatagagatggggtggatagatggatggatgtatggattgatggatggatagatagatagatagatagatagatagatagatagatagatagatgaaagaaagaaaagaaaggaatagaatagggactaacttcaatgcattgtattaacaaaaatgtgtttctataaatttgcacttaaagataaaaaggttattgctaattaaaatattagtgcactataatttcttttctcataaatggtatatttagcttaattcatcacggagaagcaggaaaaaatgtatgaagttaccatattaagtcctctttgaaatacctgctcagattttctgtcatatactggtcacgcagatttgtgggtgtctgactccaccgtgtggtgcactgagagttttgctagttaatttgaatcttttagagcattattttttctgcattttaagatcgtttgagatcctcagatataaaagctatggcactaaggaaatgcatactgtatgtacaactttctgacaaccatactcttgttatatataaaagtagatgtagatcaggatgcttctttacattcacattggcatttattactataggaaagaaaagagctgctcacttccttagtgtgttaattgatcagttatttctctgggccctcagattctgaattggatttaaaattatgttacttattttagtgacatgagcttacctacagaagcaaagcttacacttttagaaaataaagctgcatgctgccaggatgtaacagcatgtgttgacctaggagtattttatttcaaaagataacacttagccaattcacagtctttttttttaatactttaagttttagggtacatgtgcacaacgtgcaggttagttgcatatgtatacatgtgccatgttggtgtgctacacccattaactcgtcatttaacattaggtatatctcctaatgctatccctcccccctccccccaccccacaacattccctggtgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccaaggtgtatatgtgccacattttctaaatccattgtatcattgtgagacatttgggttggttccaagtctttgctattgagaatagtgccgcaataaacatacgtgtgcatgtgtctttatagcagcatgatttataatcctttgggtatatacccagtaacgggatggctgggtcaaatggtatttctagttctagatccctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatctcgttgttttgatttgcatttctctgatggccagtgatgatgagcatttttttatgtgtcttttggctgcataaatgtcttcttttgagaagtgtctgttcatatccttcacccacttgttgatggggttgtttgcttttttcttgtacatttgtttgagttcattgtagattctggatattagccctttgtcagaggagtaggttgcgaaaatcttctcccattctgtaggttgcctgttcactctgatggtagtttcttttgctgtgcagaagctctttagtttaattagatcccatttgtcaattttggcttttgttgccattgcttttgttgttttcgtcatgaagtccttgcccgtgcctatgtcctgaatggtaatgcctaggttttcttctagggtttttatggttttaagtctaacatgtaagtctttaatccatcttgagttaatttttgtataaggtgtaaggaagggatccagtttcagctttctacatatggctagccagttttcccagcaccatttattaaatagggaatcgtttccccatttcttgtttttgtgaggtttgtcaaagatcagatagttgtagatatgtggcattatttatgagggctttgttctgttccattgatctatatctctgttttggtaccagtaccatgctgttttggttactgtagccttgtaatatacagaaaaagagaattttagaccaatatccctgatgaacatcgatgcaaaaatcctcaataaaatactggcaaaccgaatccagcagcacatcaaaaagcttatgcaccatgaccaagtgggcttcatccctgggatgcaaggctggttcaatatatgcaaatcaataaacgtaatccagcatataaacagaaccaatcacaaataccacatgattatctcaatagatccagaaaaggcctttgacaatattcaactacccctcatgctaaaaattctcaataaattaggtattgatgggacaaatctcaaaataataagagctatctatgatgaacccacagccaatatcatactgaatgggcaaaaactggaagcattccctttgaaaactggcacaagacaggggtgccctctctcactgctcctattcaacatactgttggaagttctggccagggcaattaggcaggagaaggaaataaagggtattcaatcaggaaaagaggaagtcaaattgttcctgtttgcagatgacatgattgtatatctagaaaaccccattgtctcagcccaaaatctccttaagctgataagcaacttcagcaaagtctcagcatgcaaaatcaatgtgcaaaaatcacaagcattcttatacaccaataacagacaaacagagagccaaatcatgagtgaactcccattcgcaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagtgtcaatatcgtgaaaatggccatactgcccaaggtaatttatagattcaatgccatccccatcaagctaccaatgcctttcttcagagaattggaaaaaactactttaaagttcatatggaaccataaaggagcctgcatcgccaagtcaatcctaagccaaaagaataaagctggagtcatcatgctacctgacttcaaagtatactacaaggctacagtaaccaaaacagcatggtactggtaccacagtcttaaattaaattatatggccacagcatcaatctacccagtgtcagctcatttaatgagagattttattaaagtacaaaattaagaaaagatttattgaaacagaataaagcaaatggggaaaactcttctagatatggaaatatatcttagaaaacagaaactaggattatttccaaagtactatgattaaaaatgtaacaacctatgcgtgttccttggaaataaataaaaaattaaatcacgaaattgtgtgactgcaaagaaacacatggaacaaatttagtcatttactgttcaatttttcagaactatatattgaagcacagagtttagttttggcacctaaaatcctatagcaacagtctaagtaaccatgctgagccccggagcaatcaaatcaaatctttaggtggatttggtcttcagaatttttggaaacttttttattcattctaatgtgtagctaattggagaatggctttggatggttccctactagtaatgactaaattgttccagagtatttttcatacgacattttctatcactcttctataaagattctcttctatgactgtgtcaacgtttcaatgggagggagtcagagtggcaatcaaactactggtgagattctctcctattttgattttttcctctaatggaaaatgggtgatggaagaaaatatagctgagagctatcgcacaaattttaatttagacaaaaagaatgttcaatatagatgtttgaggctgaactctgcttggctttcttcaattcatttttttctaaccccatttgttaacatgtcaattaacttgcatatggctcttaatcattttaggggacagtgacaactatgtttaaatagctacttaaatgtcttgcaatttttaaaattacaaagatactttcacatacatgatttttttccttttctactaattttagttttgaatctttgatatgtaagaacaacccaacatgggcacctgttgaaagtcaccatgtccttatgtgttgatgcacattttgtaggggaaaacatggccctgttgcttaaattactgcaagcaagagcggagttgcttagcagtggctccagtagctttactgttctatttgttttttcccaaagaattctgatctcatttttttgtaacctcgtgtcccacatagtagatttatgagcaggaatagaggaaggaaacaaattaccttcaaagaagagtgcctcataattaaatattgaaaaatactgccgtggtttgctcaccaagctaggacgtcaggtgttccagagtccactacagaccagacttcctccttctctttttccctcccattaacaatgtgagtacaatttagaaaagaggggatttttaaagcaaagaaagctattaatttaaactaattacgttaaatgcactttaagaagaattcgtaattgcaatcttcccgtgtttatcaaagaagctaaatcttataactcacattaaatataatcggtcatctttaaatgttaacattccaagctatcaaaatcaatggcttaaaaataaagatataactgcagattttggtctatcagattgagcttttgatttcattaaggaataaaacagactcttatagtgtaaataggcatatttgattgccaaacgacttggaacagtgtaactttacagtctgctttattgatttatgagttagacagcagaaacctgcaaaggggaatttatgtggtaattggataatttagtcaaagaagaaaaaaatggagaactaacccagagatttgggttcaaatattaaaacctatctagccatagatgtagactttttattttctttttacacagcccagtagatggtaaacctagtgcatttaattttgaatctgttctaacattgaaaggccacccctatgtgttgctatacagaacttattactctccatttaagaataacttgttagtttcatatgtttaatagtgtgggaaacagtcataaacacaagttgtaggaaatgtaaaatactagaaacttgccacacgtcactgactgtacttggacaacctgtacattattatgtcctcactggctatatgataaagatatagatttctttcatattattttgatgtgtacattttaagactgcaattaaactatagtatgcttttgtaaaaatctatctacaaattctacatataaggatgaaattattaaaattaatggcaaaaactgcaattacttttgcaccagtctaataacttcacgctacagccacagtgaacactattgcaacactctgaatattttgaagtgatccaaatttatcctattatttcccaattttgtcttatgcaaatgaatatttacttcaaagatagcacacagaaaatttatcgatctaaaatgcacagccagataacacttagcataacatactatgttttatttttctttcagcgtttatcgtgattgttaaatcttttatttgctttttaaaaattttccccgtctattcccattctctaaccactaaagttcagctgtaagaccgtgggccacccagcagatttctaacaaatagctggcaaatttattgaattccactgaggtttagtcactaagtatgtgtcagacaaatgtgataggcagtgtaaaatttaaaatgtgaataagcctaacgtggtccttgccatcttgccactcattagatagcaccaaagaaagataaaatttagaaattgctggccacttacgtttaccataatagtgaagaaccatttttccaatggaacttaatagtatcataaagacttcttgtcataatgccttatgattgcccaactttgaagctctgaaaacctttccaaaatactttgaatagtataaaatggaactcttcacatgaaaaggaaagactgatggaaaatatatattttagcctctttatgtattacctagtttttaaggattataccatgtgaatatctaatattttgaaagcattcacgttatttggtaattacagcagcctaatgaagtataaaagttgtgtttaaaagggaatatttgaaaacactagatgaatggttgaggcatgggttgagaacaggatgtgaatgaaaatggacacacaggtttaggggttaataaaaaatgtcctaaagttggattgtggtgatatatacatgactctataaatttcctattgttcattgactatatgtttaaaatgaaaattttatggtatgtaaattgtacctcaaagttgtttttaaaaccctattgaatagagaatatatcaattactattatatatttaaaaagataatttaaggttaccatcaactttttcactccattattttgatgcatagcaaagggtgaaatgtgatgaatgttgttaaataacctggaattaacttaaatggtagatatttattgatggcctactgatgtccgcaagatcttacatagtaatatcataatgttcccattgtttacattctattccatttaatgaattttaatgctaaagcatttttactgaagctgatattttaactcagatctgctttctccactttaataattagccctttattaagtgaaaattaacctagaagtacaatctcccaattatttctaggcagcattccaaaatgttccctagagtttgatttactcatttatctattttgaaaagtaaccataattacttgaaaatacgttatttctattttcaatgtttgtaggcacgtagtagatgtataaacgttacatgagatattttgatacaggcatgcaatgcgtagcaatcaaatcagggtaaatggggtgtctatcaccttaagcatctatcctttgtgatataaaaaattcagttgtactcttttagtttattttaaaatgtagactcaaattacttttttattatggtcatcctgttctagcaaatactaggtcttgctcattatttctaatttttgtacccattaaccatccccacttcctccccaacccctgactacccttcccagcctctagtaaggatccttctactctctatctccatagttcaattatcttaatttttagctcccacaaataactgagaacatgggatgtttgtctttctgtgactggcttatttcacttaacgtaataacgtacaattccatccatgttattgcaaatgacaggacgtcattctttttatggctgaatagtactgtattgtgtataggtaccatattttcttttttttattattatactttaagttttagggtacatgtgcacattgtgcaggttagtcacatatgtatacatgtgccatgctggtgcgctgcacccactaactcgtcatctagcattaggtatatctcccaatgctatccctcccccctccccccaccccacaacagtccccggtgtgtgatgttccccttcctgtgtccatgtgctctcattgttcaattcccacctatgagtgagaacatgcagtgtttggttttttgtccttgagatagtttgctgagaatggtggtttccagcttcatccatgtccctacaaaggacatgaactcatccttttttatggctgcatagtattccaaggtgtatatgtgccacattttctaaatccattgtatcattgtgagacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcagaggtacaaggaggaactgataccattccttctgaaactattccaatccatagaaaaagagggaatcctccctaactcattttatgaggccagcatcattctgataccaaagccgggcagagacacaaccaaaaaagagaattttagaccattatccttgatgaacattgatgaaaaaatcctcaataaaatacttgcaaaacgaatccagcagcacatcaaaaagcttatccaccatgatcaagtgggcttcatccttgggatgcaaggctggttcaatatatgcaaatcaataaatgtaatccagcatctaaacagagccaaagacaaaaaccacatgattatctcaatagatgcagaaaaagcctttgacaaaattcaacaacgcttcatgctaaaaattctcaataaattaggtattgatgggacgtatttcaaaataataagagctatctatgacaaacccacagccaatatcatactgaatgggcaaaaaccggaagcattccctttgaaaactggcacaagacagggatgccctctctcaccactcctattcaacatagtgttggaagttctggccagggcaattaggcaggagaaggaaataaagggtgttcaatcaggaaaagaggaagtcaaattgtccctgtttgcagatgacatgattgtatatctagaaaaccatattttctttatccattcgttttttaatggacatttaggttgcttccaaatcttgacttttgtgaacagtgccgcaataaaacacgggagtacagatatttcttcagtgtactgattttctttcttttgggtatatacacagcagtgggattgctggattgtatggtagctctgtttacagttttttgaggaatctcaaaacttgttttccatagtggttgtactagtttacattcctaccagcagtgtatgagggttcccttttctccatatcctcgccaacatttgttattgcttgttttataaataaaaccatttgagttgaagtgagattatatctcactgtggttttgatttactattctgttatgatcagtgatattgagacccttttcatatacccgtttgtcatttatcttctttcaaaaaaaagtctattcagatattttgcccatttttaatcagattattagttttttcctatagagttgtttgagctctttatatattctagttattgatcccttgtcagatgggtagtttggaaatattttctcccattccatgggttgtctcttcactttgtgggttgtatgctttgttgtgaagaagatttttaacttggtgtgttaccatttgtccatttttgctttggttgcctgtgcttgtgtggtatggttcaagaatttcttgcctagaccaatgttctggaggtttctcccaaagttttcttgtggtagtttcataatttgaggtcttagatttaagtatttaatccattttgatttgatttctgtatacggttcaagatagaggtctggttttattctgcatttggatatccaattttcccagcaccatttattgaaggactcctttccccaaagtgtgttcttggcactttgtcaaaaattaggtccctgtagatgtatggatttatctctgtgttctctattctgttctattgggctgtgtgtttgcgcttaagccagtaccatgctgtttcggttactatagctgtgtagtataatttaaagttaggtaaagtgattcctccagtttcattcttttttgcttaggatatatttggctattctgggtctgctgcagttccatataaattttaagattgttttttctatttctgtgaagaatgtctttgttagaaaatacattattataatgaactcttctattatcgttgtcgttattatgactaagcgtaacatcgtttctcaggtatattacaagtaataattatacacaatgtccaattttttatttttaaacggttctgtggtcaagattacgcagaaaaatttatatgctttacttctctgctggagatttttgacccacttttttgtattttcaaaaataaaagtttaacctaaatttgataagaagccacagacactttttcctccagaaatatgttgatataccacaaaactcatatgtcaaggaacaatgtaggggagacactgaaatagactgtttcctttggcctattgcatatttctgataaaagtcaaaacttctttagctgacaaaatttaatttaaaggtaatatttttctaagtaactctacttgggggggggggtttaaaaaaagagtagtacaaagctgtgtgaatttcttctttttttacttgttgaattattataaagtataacctgaaacttttcaacattttttttctatgaaaataattatatttcttgcattttcctatctttggaaagtacatatcatcccaaatcttttgatatattttgtttctttcgttttctaagtacgtgtgatatgtggccatttccctttcttgaaaatagcaatttcaaaattactggctctttcaaaattactaatctaacagtggtacgttcctccatcaatcagtagtctcaacatgaagtattttaatatcttttactaaaatattttcttattttctctaaatttttcctttctttgacaccacagaaactccaataattatttgatatcattttcttcattctgttaagtactttagcctgctgcagtataattttgctggccattttctgttactatatatatgagaatggtttgatgaggtaaagcaagattttaaaaacagccctgctctctgctcagttaactgtaaagtcctatatttaaaatgtgattaatgtttgaatgattttttggttctataattttgccctttaccatattcaatggaaaaatggttaattcgatttcacttgttttattttcctactttgaatatatagtgctgtgaacatagttactgcatgctcaaatgccttttttataatggaatgttgagataagctcaaatgtcttttttaatataatggaaagatgatataatttgctttatattacttgactttgatgaagaaaatctagtgattctgaaaggtactggattgagaacacctcatagagcatatgtgagtgttcacatcagtatccgtgatttgctatgtcctctcactttgtttccattagagtttactgattttatacgaagccaggctgataatttcacaagaatagttgtatgtggttggcttatttgttttcttcaaatgcttactatccatatccccctagatgtatatattaggtgaaaatataactcaaattatacatccctcacatctttaggacaacttagaaatctagtagacaagtagagagatcattttccttcagattgaatcttctatccccaatgttttcttccacaattttattttctttcatcatattctcataatgtcaaaaaagaaaatgattacattgtctttttttatgagtgatttttacataggagattgttcttcccagaagtttcaataatattctgttatttgtacaagttacttttctatttcacaataagcctgcgctaaagtgctaagcattttttacttatgtggttccagaatacagttctgacgaggttaggtaaagtagctggtaaaagatatcctaagtacaagctaaaagttaattacaatttaaatgtaaattttgtggaattaatgtgtaaagatgctggcaaatatgtgtcatgcatgttttacagcttacccatagtagaatcaattggaaatataaagacattttattttataattttagtaatgaattgaattattattaatgaatatgttaagtatatttgatagcctttttccaaatctacttgtatgatgcactctggcaaaaaaaagcaaaaggataacatctacaaagtgttgtatgattcttggatatacacaatatatattaataaatattctgagaagttctgtggtatagacacatgttcatcttcaatttccaaaatatgtttaaccactgagttctttttaatgcataatctactcaatgcataaagaaaattttatctctaatcatattggaacagtactacaaatatgcgaatttcactagaaatgcctatacattatgataaaagtctcacttttatatgatgttcaatgatgatttttttcaatgttaataattttagtggtggcgacctttctaaaaacacagaagctcatcctcaacagtttttctaactatttaatggaaatatgtatatttcaaattccatggaatgctttgccttgagctccaaattgcccaacattcctctcacaggttacttggtccttcatgtcccctgccaacagataaaagtcgagtgtttggttatatgtaagctgttgttgttcctattatttatgacttatgacaacaatatgactcatttgggaaaatgtggaacttatcaggaaggcctgtgttgcagtgatcacttacgctatctttgctttgctttgtaatgctgagcttctagaatttccaggggcagtctttgaaaaaaaaaattataaatagaaaattaaatgctggtttatagaagggtctcttgcaagtgagaggcactgaaacttaaggttctgtagcttcatactaattcctcatctagatagtaattcttactaactcacattcagtctttcctcccattaaattaagcacacacactctgcatgccccaagcctaatctttgctagcttgtttcctacagcctaaaataagatcctatattcttattctctgaccctccaaaaccctttctcagccatatgctagttaaatcatgtaaatttcctaaaaatcaccagattatacagcagatattaatatttatctttctgatcacagagcatgggtttttctgtttttaaaatttttttaaattatactttaagttctagggtacgtgtgcacaacatgcaggtttgttacgtatgtatccatgtgacatgttggtgtgctgcacccattaacttgtcagttacattaggtatatctcctaatgctatccctcccccctccccccaccccacgacaggccctggtgtgtgatgttagtttttctattacattgcatatatttctgctttgtaatttacttatatatctacagtctgcctcttaaaataaggcttctgtaagtataggggcaacaattttgttctcactgtgtggaattgagtagtagaagctgaacgatttgttgaattaaattgactaaatgctatcaacatacgaataagattaaatttctttttttctcacaaatgtccatttggaggatacttttattttaaaatcataattaaagaggcagtataattgttagagggcagcaagtttgttacttcctagttatgttaccttgggcatgttgatgtttctaccttcatttgtacatgaagatgataaatacttatgttaatatgattaggagatggaattaattatataaagtgttagcacataagttcccacaaatatctgtggtggtgaggatactgatgatgatttcttttctttttttttttttttttgtttttttgttttttgctcttctttgaccactctggtataaaaggttaaaggactatgtgtatacttcattttttcctctactaaccttggaggctaaggggatggaaaaacttttaaatacatgtacacagatatgattacagatgtataatttgggccctctaccctctctgagtgtattcttatttttttaaatcagtttcctttcacagtctccacaattgctattgaacttttatcactttgatttaaattccaccttgattctctcctctcatcctcagcagatacctagggttttgtgcttacgaggaaatgacatgttatatcgctgataacttataactaaatatttgtgcaaataacatggacaggtatttttacatatactgtcacatctgatctttttgaccaaaaccaatgtagttgactactgaagaaatgagaatttctcagataagaaaacttcattgctggcttgctattatcattcttgggctagacatgagaaaatcaaggttcagaacatgttgatgctttgcccaaggtggcaagagagagccctgaaatttaaatcctggttactgttaacatgatttcaccctgatactctgagagcaccatgtaggaagcattcaacttcttgcgtcttcacatcttacttttgttttctgaaaaagagccacctctcctcctgttgatattttccgttggccctgagctttgtgcttcactctggttttcttgctttaaacaggtttttttaaaatcaagtttatcttcttacatttaaaaaaaatcactttatgtgttggcttctttcatgtagccttaaagtatgttcaagtctgattgacctgaattttattatgtgtggagacaaaagtctgcaaaagtaatttaaactatttttattagagtgctccttgatccttaatcaggccagcccttgaaaatacgatttctgctctcgtcatccacttctctcttctagctgcaatggtcattgacgagctcatgtaccctgattactattgatcccattgaacctatctcaaactgtcactgttgacctctctctctcattcttaaaattctcacatcaattgatgtgagattttctctcttttctagttcttcttttctttctctttgactgttctttctctttatttggtgcttttctttccatgtcagttaaatttgtgttctccatggttctctctttgttctctctttctgctttcctctaacgcttgaaaacactgaaaaaatacatattatacaaatgtaccctgtttccctctttctctctgtacagacacacatagtgattattaaaatgcaaactcacttcaacatactgctgatttacagtcgcatttcctccctatgaatttccttagttatcggatcaaatattagcaataaaactactgttatctgtgattatgatcaatttcaaattttgaaatttatcttcgtgatcaaaatagtggtaaccattcatttgggacataaagttatttaatacctgatttctacctacatttcttgttaaattttgccaaactccttatgctcttcagtgccctgtctccacaccttgtctctcttcaaccagaaatgcttttgtttttacaactcctatatccttgcgtatccagtatgcatatacagtatttaggactctcatttagaagtaacaaaattgaagtaactaaagcaaaacaaatgagagagaaaggtttttcatatggaaacaggaatgtgtcatagaatccaagggcagtaataaagttttgactcaagaagggactaatgcctgtgttttggttatttatgatagccatttattattcccactaatggttttgcgtgttgagaaagctcacctggatggttctcttttgtggtttcttatgtgattttagtccattgttgtctgatactatagtaacctgaatgctcaactgggctgaacgtccaagatcactcattcacatgcctagcagttgttggctgaaagccttgttgtgattgttgctgaagcacttatccatggcctttcgatgttacttagctttctcagagcataatatgttggatggattctaaaagggagcaccctaagaatgactgttctaaaaagatagacgtggaagctgccaggccacttaaggacttttgccataactggcacttggactatattctattggtcaaagcagtcaaagagtcaacccagatttaaagagctgaagaaataaacttcacctcttgttgagggagtggtaagaggagcatgtgctgtgggagctattattgcagccctctttcgaaaatgctatctacgggctgggcacggtggctcacacctgtaatcccagcactttgggaagccgaggcaggtggatcacctgaggtcaggcattcgagaccatcctgaccaacatggtaaaaccctgtcgctactaaaaaatataaaaattagctgagcatggtggtgggcacctgtaatcgcagctacttggttggctgaggcaggagaatcgcttgaacctgggaggcggaggttgcagtgagccaagatcgtgctattgcgttccagcctgggtgacagagcgagattccatctcaaaacataaataactaactaaataaataaataaagccataccgcattggaagccatcagtgtttttgttaccacctcactccctatgcatctacttctttcttctctctctgttcatggacctttgctcttcctcaatccactctgcaaactagggacttcgtaagcacaatttgctagtatatgtgacacaattcgaagcactcacagtttgaccagactcttctgtcaattctaattttctgagagagattctgatgattctctcttaacacaagcattgtgtgtattctgatcacccataacatggagttggccagaattacgtggcacagacatggttgttactggcccacctttttgaggaggattaacatttccaagatgaaaggccctagccataacccctctaaagcatctgttactcccagcaatgcttactaattattgaaagttctactttaacatcaactcccttatgacatcctccgtacaagcatcactccaccctgcatacttccatccaattttatagattctgtgatgtttcttgctctataaataacgtcatgcacctagatggatccctactcccagattctaggttcacgaaacatatcaatatttctcacacaaggtagttattcaaccaatgaagatcatcgatatggtaataaaataagatacatttatatgcgtatttgctctcatttgttttaaggcagaattctaactatttaggtaattcataattgatttgcctctataattgttaggattaatattctaaggaataatattgaggtacatctgtgaatttataaccttgcataaggagctccttaaccacttagtccatgttcttggtataattctcattactcagttcagggctatagttcgctctggaaactgctaagcaaaactgatgttatcttctaatgatatgtatcagaatttactccaattggtgtaaattcacttacactaatatacgttatgcaaaatgatctgcatgataatgttatgggcactctggtataatttagtttctgctctaaattataataatctaataatgactgaattttaaattagaatgatttgaccgctagctgattttgtatggatttgacagaaataaataaataaatgtattgtgttcgtgtccacatgctgcagagatccctgcctataactggctcagaaattcatatgttaaatgcagaatatactttactatagaacttgatcgaaaatgtctttattgaatatataaatattgaaatgttttatagttatctaaaattcacaatcagtatctgccggaagccatcaaatatctatcagacaaatagcaatacctgtttggggcatttgacttccatttcttagattcatagcttccctgaaatttaactgaaatatggcacataatgactgagtagactacactaaggccaggcacagtggctcacgcctataatcacagctctgtgggaggctgagacaggagaattgcttaagaccaggagtttgggaccaggctgggtcacatagcaagactctgcctctacaaaataaaataaaataaaataaaaagaaggtaattaaggagtattttccacatgcaattttctcattatatctcatccctgtcacagttggctgaatcttacagattaacatcatgtctttggtccgatttgagtgtgacttcaaagataaaacatatcaattctacatataatatataaattacctattgaaaatgatatctgaaatagttgatattgactcaaaatgattattgcttttttcataataatcccatagggaagaaataaatcgtttcacttggataatttatgaaagtaaaaaatatttatgataattctatttaggtgatccacctgcctcgacctcccaaagtgctaggattacaggtgtgaaccaccactcttggccaatttacggtcattttaaaggaagctacatggtagaggtggttgaggagagtttctgaatttcgtcttcttggaaagttagttgttctttgtagagcatgctgactaataatgctatcctcccaacagaaaatccaatctgatttgacaagtcatgagatcagtttagaagaaatgaagaaacataatcaggggaaggaggctgcccaaagagtcctgtctcagattgatgttgcacaggtatatgttatttcagaaactaaggaacgtgttttcgttgggcattatactccagtctatattggacaacttgattattggcaagattggatttgaggacattatttgaaaactataatttgatgtctaaacaatgagtgttttgctctctacattttaaagataaaataggttaataaattaccttttatttagtataacattaagaaaaaactactgaatcattctcccaaatgtatgttttcctgtgttggatgaatggaaaaatactgctttattttgtttttatttttctgtatatcttcagaaataaaggcagatctatcaataaaaataggaccagttattgtttgaaaggcaaaattaaatcagtgcctttttacactgtccttacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtggtatgtatttctggtggcaaatacgcaggtaccccttgactttcctcattaagaagtaactgctcttttataagagagaattgttttcagataaccataataattatactatgtaattttaagattgagaacaaaaattggcacatgtattgtggcctattctgtgtgtcttttttgagtctataattctgctaagaactgtgcagaatataaaaggatgttgcttgtgtttaatttttatgattctttaaatatattttaaatggaaatctagaaaggaaatatattaatctaaaaatagtaacaacaacagtagttgcaataatcctaacaacttcagaaataatggatgccaggtaaactacgtgacatacagaagtcacctttaattcttaaggctacagattacctgagagaatttaaggacaaacagctggtgaatggcaaagcaagattccaattcaggtactcttattccaaactttaataactttcctttaaacaccagtactggatatacagtgaaatgcctcaagacaacaccgaattaaaaggcatggaaaggtacaaatagcctaaagtataaatctgatttaaactttataatattgaacggtgtcctatgttgctgttattggaaactcaccaactgagatgattcctctgaaaacaaagctgaggtatgattgcatctactcgagtaacataagtattattataactctacatgtactatcggccattagagtgggaagtcacataaaatgaaaacacagaatgttattaaagggaaaacaagtctatttagtacttgatattttaagtattgtttctacatctactccataatatcaatgaaaaacagagtccttcagatacatcgtagtcatatcatgaatggggaaatatttttctttttaacaaatatcttaaaataaatacatatatttatgtgtgaaaaatatgaggtattcttattcgataatatattttcataattcaagctgcattttagtggtataattactttaattattctcacccccaaaaagaaacttggaatagaaatgatagaaagtagttagttgatattagatgagtaaggataggaatatatgggaacatatcccatcttaaattttgccaaaaaaaaaaaaaaggaaagcataaatgacccaagtgccttattcatgactaatatttgcaaagtgagcacttttcgttcttttctagaaacaggtctctaatgttaccttataaaatgtatccaacagtaaatatgagctgaaaacaatctcacctgtgtcaagctgtgactgtgccctgcgtcagtacaaaggaaactgctcaaggcatttgctcaattggtttctggttctggtttaaatgtcaggaccaattgaagcagttctttcataagaatatccttacactgtttagttttttcattgtttacgatgctttgtggtgtataccataatcatagtcttgccttcaagacatgtttgtctatttataaaagtcttactttcatgaacacaaatataaataatatttctcccctttgtttataaatattttacttgcctattgaatgaaacaatgttaatggctaacggtaccttgagggaactttcttcatcaaaataaagcatttatattttttgaagttcagagagtaaataatttagaaaaatctctgattccaaattagcatcgttgatttccaacataataattaatttcagtgtttccagatacacagatatttttatatcttctaagaaaaaagtaaaatgaagtaaataatatcatctgggaaactcagacaaaagtcataattattagtgatgaaggaatgttaacatcatttgtcaaagaggattaatatggaaatatacatgtagcattgatcagataattgtccagcctttacaaaatgcttttttttagacattacttttaaactgaaaagagaaattaaacccaatttttgttctaattccataaaaacaattacctactgtcaggtttattttttggtaatactaaaataagtactgatagttcagatttatgactaaacaaattaaagcagagatacataatgtaaactattatatatacgtgtatacgtatatacacacacgtacatatatttgaatacatggccacatacatacaaagacatatatttctaggaaaactacaaagcaaaattaagacatcaagtggtgttggagtggtgttggtggtataattgtgaacatagctgtcttccaaagttatgacacttgtcttatgatgcttttttatagcaacctatgttttgtgaaaccgtatgtgtgtgctttatatttgtgatgtacatgtgaattgtcaataatatttttatatctggttttcatcagcacttttaagaaaataaagttgtgtaatttaattaacattgaaaaggaccttactttcttatatatgatacaatatatattgaaattatgatgtagaaatttaggtgctttaatgttactaatatgtaagtaccatgagaacaatagtgaatgtgtgtgttttggccaccactgacttcccagtgattcaaatactatctgattgatagtaaccactcaataaatacccgatgtaggagtgaattaattcatccaaatttatggctagaattatataactccaacatttaaaatagaagtcatgtaaaattcagaattgacatttatgttctttgattgaagaactaaatatatatatatcacaaaacacatatatatgattaactctctgtttaataagaatagctgcaaatgacacatatatgcatgtgtgtagacaattagaaatattaaatcaacagaaaatgcaaaagctagatattgaccaccgctgcaaaatgctactctattaaaatttcaaacatggaatagcaattaaggggatctctatttatttctgttcataatattatgaaataatttaactctactgattatcatgttttgttttatgtttaaacttagaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtgtgtgcatgctgagaccacaaacacttctttccactttccttataaattgtaaagcaacgggcaataaattatgtatgattagagtcttagcaattctaaacacctctctctctctatgtatatgtatacgtatatatatacacacatatacgtatatatatatatgtacacatatacacaaagataaacatatacacatatttcgatgtggaattctcattaagaaacaataattaatcagtgaggctctgcttattcagattgaaaaatacgtaacgctcagggaggtttttcctggtccatcagatagctctaaaagggtttcttagttgtaagtgttccttattttcattatatatatctacttgtgatgacttgaagactggtaaatattataaactgtatctatttatatgtaggtctaatgttgttaacatattccacagagaccacattaagtttaaaaattacacagtaattatttccctatatggccaagacttgcaaaatctaccacacttggctaataagatagcatggatagccagttaagacctacgtctctgtaattatttttgtatcattgtcctgatcagagtctcatgaccagctccacttcactgctaattcaagatgcctatatctctccatctcacttcgctcaactcaaatattctgtatagattatgatagtaagtagtctcttcactctgttgattgtttgttttgctgagcagaagctttttaggttgatgcgataacagtcgtctagttttcctcttgttgcctgtgctttgggagtcagatccaaaaaaaatgtttgcccagaacaatgtcaggaagctttttcctgttttcttcaaatcattttataggttcaggttttaagtcttgagtccattttgaactggttttttatatgctgtgagataagtgtccaattgcattttcatgcatttggatatccaatttctcagaaccatttattgaagagaatgtccttttttcattgtgtattctcggccccttggttgatcagttgatcataaatatgtggatttattattgggctctctattctgttcctttggtctatatgtctgtttttatactaccatcctgctcttttaattactagagcattatagaatatttttgaatcaggtaattatgatacctccagcttcgttcttttggcttaagattgctttggctattctgggtcttttgttgttcaaaatgaaatttgggattctttcttctacatctgccaaaaatgtcactggaattttaatagggattgcattaagtctgtaaattgctttgagtggtacagacatcttaacaatattatttattccaatccatgaatatgggatatctttccataaacggatatcttagtatttccaaaaatggacttctaacattttaatttcgttctgactgaaagaactgaatttcttggaggataaaaagttatatttttacaactcaggttctcaactttagtgaatagaacaacatcactgataaaattgtcacctcatcttagacagaaatatgaatgtccatgtttgagaaatagctaaggagaggcatatttcttgcatctcagcctgaaagtagattgaaggttatatcttcaagatattagttgccaattccttaccatagaaagtaaattttataattaagttgaaatctggaagtaatcatttttcttagatagtcttgtttttatattttaaaaaccctctaattaatatttgttatgttttaaacaagtttgttgccatcctatgacaaaagattctcctactttgtttcaaaataagaaacactgatactcaattgatgggaaagcattatgataatcttgaaataaaatacatttcaactgttcatttggtctaccaaggtacctttggaatgagatacctttatatcctctagagaaatttatcattgtttaaagatcaccacagacagaaaaattgtatctgcacttgataccttattccggtgcttatcaatttttatagatgccaattatttcatatttaacatcaattacgaaggactgagtaatctctagtctcaaatgtattagagattgaataatctctaatattaatcctaatgctacagcttcagttctggagatatattgtttttgtaattataaattttaaattaataaaatgaatgtatgttatagttataaattacaaattttcagtttataatttgacctgtgtgactttatactaaaataatgtatggatgagtattttttaaattaagaaaatatatgttttggtaaaggggagtttctcagtttactttttaaaatagaggttttttgtgtgtgggctttttatttgtcataggaatttttacgaaatcattgcaagagtaaatttaacataaaataacagaataaatcaattagaatttaaagcaatgaaagtgacattagacgaataatagtgccctgagttgattattattcagaaatgaatgattctcgtaatgatgtcaaaccctatttattcctgaaaatacatatctgagagcttgtgtttattctaaccatttgccacatagtaatatccttaaagcaaaataaaagtgtatgaagaaatcatatttaactttaatagtatcacagaatacagcaaaaacataggccaaacatttatttttgaagtaaatattgatgtagaaacatttgtgactaagggatcatgtataaataccatcttataaaaatgctgtaagtcctatattctttgcctgagaataaaaatattgtctggattttgactcaaaatattttcaacagcagtagctttgtctaatgaaagcaaaggcaacaaaggaaatgttattacattattctttttatgtaagaaggaacccttctattttaaccatcttcagaatttatatggttgtgtctgccacaattgagtatgcattacctttttggagtaatcagctctggctgccataacacaataaaataaactaggtaaattgatttctgcaagtgtggagtctgggagtgcaagatcaaggtgctgatccatttcattcctgaggagagctttcttcttgtcttacctttttgctgtattcttacatggtgatgagtggggagagaaaatataattaatttattaagagatattaaagctggcaccattgatgtaataatacctataacccctttttatttctctatgctctgatttttatggaaatttacataaatagcaatactaatatcatcccttaaatacattgttaacttcgtgaaacaatgactactaaaacattttactgcaggtggcattgtgttaaacgtatccattcctcgcatacacacacaaagtataaaactcaattttccttaagatggcagtgtctcctgttttttaaaaatgtatttagctggaaataaacaaaatgaaataaataaaaatcaatactgcattagctctgggaagatagaatttctttgaaatattgaatctggaatcatttttctaccaataatgcataggaaaaatatgcatagaaacacaccataaagtatattttccctcaccccccacacacccctacaacacaaaattcttgcagtcaaaagggcagatgcttttacttaggaaaaaaaaaaatagaagggaaaatctgtttaaaaaatgaatttacagcctcagcaactaaatgttttctaaatgtacgcacacctctcctaaagaaaataaggaattttattatttggaattggaattgttatcaaggttccagaatatttatttcgattgtagcattttagatgctttatacatatttttatcttttgtgtttttcttgcttatagatagattcttattttggttgtacacacacatacacatagacacacacacacatatatatgacataaatatatgtatcagtcagtggtgcctattgggcttagggcataatgcacaaataacgcacttgtggtggtggtattgttttaaccaattccattacaattgaaattaatctggagtctacctttcagatttcttagcaacaaaagccaaatcttgtccatgttttatttacctgtaaggtagtaaaataaatgtaaataaagcttttgctctatacattcaggcacagttttttattgaaccatccctaaaggtaaataatgagaataaaggaagggattgaggtggtacaatatgtcatgctctctcaaactgttgtctgcctttaccctcgcaatattcctgtgttctattaataagtatagtaatcccatttgacagatgtgttgagaaaaatgaggtgttctgccaaaaatcatactcaagtcgagagtccactacgtatcgcagagcctaacatacttacattccatcatgctgtttctgcagagccaaatatttatatctattgttcagattcccaggcttcatgacagacaagggttttttttaaaaaaaggtgaaaacacataccaaagaaaagaaaaccaggagcaacttgtaagagtataaactctttatgtaaattctaccagttatattttctaacttgtaattaacgatttgcaagtcttcattcattcctttattcaatacataaagcatatttagtgagacctttctttgttcaaggaactttcaggagtagagaggagtaatctaaagatgtgtgaggcaagaagatttgcctttaagaaattgtaatttatctggcttttgttgatgatttgactgcctttagtagaaagagatgctgggatttttattaaaccaaccaactgaaaatcttaacaaaatataggcacatctgagaaggtggtggagaaatacagatttgttcatttcttatgtgagaatatggataatttgcttttgagggtgttggtatcaaacactgagaacaggagcacaggatcaagtaattagtttttctattaatgggaatgaatattgtcttcacattcatctttttgtccctattggatggcaaaattatgtttaaggaggaagtgacctattcactgtattgtttttgagcagatgtgagacactttaaagatgtaacgaggatacagttgagaattctaggtattacacaaatacttttaccttttgagagaattaatcttctatcttcattttgattccttaccagcatgagctagtctcacttgtatatagaggattgtaaaccttcttgccatattattgacacatgacagtaagttttcagtgagaaatgagttttatcttcagtttgacttatatcattgtatttatcataaactttggctataaattatcttagagaaaaattcgtataggtttcttttctaccatgacgacatacaagaccctatcttttggacaaacgatgtcatctgccctagacagtttttattcactcttaatattcagaatatatgatttttataaaatattattttaaaacgtgtaagaaaatagttattttaaataacagaaatataaaagttccaaataagtggttataacgaaatttgaattaaagagtaaactaaattacatttcattataattcttttcaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggtaaaacctatatcactgaaggttattttgaacatacgtgaaaacacataatatgattttgtaaggaagtattaacatgtagcaataatagcattataaatattaatattgtttcatattccctttcttaaaaattaatctgtgcttttcaggaccatgataaaaccaatggtaagctttagcaggagtctctccaaaagcttccttagagttcagtaaattatgaataagaccttaagaaatacataggtcattagtctgaaaattggtccagagatgagatcctataatgtactggcttgcctaagaccatactgcccagatgaatcccacagccatgaagagggcaaggacacagagattgaagacagttgggctggacaggacttgcaagattagcatattgccaaagtcgcatttcagaaagaatctcaaggtgtctatgcaggggctatcatttccatcaccaaatgacacagcgactcctgtaatcattagccgttaaattcttgccctttctctgatggccaatcatttcatgctgcttagaacttagtcaagagactcatagcttagtatttttttttttactgtttattcattaccagattacctgaaagtgtgttgatataaagaaaatagctgatattgataacatgttttacctcaaaatttgccactgtgttaggccatttacacccacttaatgttttaaagttaccaaattaactagatgtataagacgtttatactttatttttaattcaatgtggctatccagattattcaaagttgggaaattttcaataccttatgtaaaaacttacaatcgtataaatgagacccaaactgaaaactgtctttatgtagattcagagaacaagtagtaatatattttgttacataaaatatttccaaataaatagtagggaattaaattgtttttcttctctttcagaataaatgtaatgttagataagatattgaattatagttattcaggatcatacatgagattactatagcaaggaagatacagtatatacaggttaaaactcacattagccttattttttcttatcattcaaacatattacttgaggtatttttgcattagcctcaccatgaaatcattcaaatgttataaggtaatgacctttgcagaggtttctaggttatccttctcatatagaaggcttgaatagtctggagaattgtctgcttgttgaatctgcctggaaagtatttttcataacgtcaaggagcaaagctactgtgagatctagtaggaaaaaaaaaaagcttagaaaactggcatttattttctttctttatagaataaagataatttatcactctatctagatcttttcaaacactaagctgttaatgacatactctaaaatctcttagttgtcaaataaagtatattcatttgcatctgaattacagaacttttttttttttttaccaatttatttggaaggttctcattatttctttaaaaataacaatcataaaagaatatatgccctgcagatctaagccagtcacatttatgataatcattctaatattttaacataaaattcaaactctcatatatgaaaccccgtgactattgagtacattctcatttctcatggtttcttggtaggtggagagcttaattcaagctataagtttcatctgctgtttcaaaagataaatgtcacatttttaaaaactaaattaaattcatttaaatgcaatacattaaatgtagttgccgatcattccaagtatttggaatgtgactgcagcaaatttgaatatctagagtcaatttcttttttattattttaaaaaatttttagacaatttaatttatatctgctgaatttctcccagttctgttgacccaagaacattatatttattttcgtatgaaagtatttgaacatctagtttcaaatattcaaatacataaaaatgtcaattactcatgaagtgattttttgacctttagtttatccaaacaaagcataatttcaagtacattgactatagttaaatagtatcagttttatcttaaagtatcttaattatatttaatatatattaaattccagaaaaattatttagtgtggcttgaagagatacatatggcacaacttgagaagcctaaataaattggaaaactaggaaaaggaaaattatagtagataaataataaaaaattcttgcatagaaatatatccacaatgtatcatgggtggtggaatggacagggaacattttaaagccacaaattggcgccaagcttcctaaaagacaaaaccaagaagtaaacatatttttgagacccaaagtttccaaattattaaaataataattaaaataattttaactttactagtagtatgttagctttttgctagaacttagtgccagaagaaaataaatgggagggtcataaaggtgataacacgctgattcatattcttataataaacaataagaatgtttatttttttctaccaacatggctccatgaaaaagaaaaatttagtgctaaagggccattcaggaaaagcaattctatgagaggaaaaaatattggagcagaagtctaaagtagtctagcaattgttttcagattttcagattctctattttattaatttttaattttgtatggatacatactgggtgtatatatttatgaattataggagacatttttatacaggcatgcaatacgtaattgtcacatcatgtaaccttctgtgaatatgctttcctgcaactgagcttttaagtagaattagacatcagagatttgaaggttatttattttctctgaatacagaaaaaaattttctgtatctttttcctggaaagaagccagattgtttctaactgagaacacatttctatacttggccctatatctaattggaaagcagggcttcatattcatgtgtatgtcatagtactagaaggcttcaatagctaaaaatttttgctaacatagagttttgggtttgaaccagtcacagagaaattggctattgagccttttcgtgccaagcataattgaagaaagaaaactcaccatcgacaactcaaaatatgttgacttctctaggaacctgtatcaatctctcagtgaatgtatttatttgaaaacacagttgggctattactttagctgtaaaagctattgaaaataaagctcagtagtactctcttacttgatgatggcatttaaaaggtgaagtgagaatgttttatagggggcatgaagtatcaagtactgagtgtgatgaaaattaatatactggttaatgataatactgagtctaaatgtactagtttttcctgtgatatgagaaaactagaattcacttttcaagatcaaaattagcaaagaatttggaagtattgctccaattggagaatcagaagtcaccttaaaaacaatacagattttactaatctatagtaatatatatttcataaagtcttcatgtgacacaaaagttttagggttttggtttttaactagccgtgttatataatcgaggaaatttcctatcctaaattagaaaagtataagcatatttaaagttcaattcagtttttcttacattacgaagctgagaaaaatgaatctaacattaaaatcaaaagcaatctggtctggcttactgtattcatgtcaccaatgcggtttatcaaaaatccctgtcatatcaaatcaagcccttccacaatgatctaacacttaagtttttatgagaaaaaaaaaaaattggattctctatactcatttcacctccttaccgtggctgtgggcaggccccagatgatgcattgtctataatataaactatgttggtgaccaccaaagcagccaggcattcttgctgttccttcatttcttactagattatgttatttaattaatttaatagtatttcatcgcctatttatagggccatagtccatgtgcaagcagttttccagtaccaccaaaattctcaataaggtcccatcacaactatcatttaggcctaccataaaatacacagaattaataaaatgagacaaccatcattgtgtgagcaatacttaagtcagccccatgcaccttcagagaggtactactagcattgagatgaattattccaacttgtagggaaaccaaatagataccgaaagaaagagtttattcttatttatttattttgagatggagtcttgctcttgtcaccgatcctggagtgcaatggcccgatctcggctcactgcaacctcctgggttcaagcagttctcctgccccagcctcccgggtagctgggattacagacacctgccaccataccctgctaattttttgtgttttcggtagagttggagtttcaccatgatggtcaggctggtctcgaactcctgacctcaggtcatccacctgcctcggcctcccaaagtgctgggattacaggtgtgagtcaccacacccggccagaagagtttcttacactggccaaaagatcagttatgttctttataaacttggcataggcttagggggcaattcaccatttgttttctaatgctgtgccctttaaaaaggaaggggaaggttgcctaaaacgatgaaagagatgttataaaaatcaagcttcttgagaaatatagtaaaattggaaacaccttaaatgttgcagtgtgttaccatttacacaaaggataaaatatgtagaaatatacattatttagttatatataatatatagtaaaagcagaaagatgtttgggaattaatataaactgaatacagaacaagagctatctctgtgaggaaagacaaaagaattgggtgggatatgaacaggacacttaaatgatacttgtaatatttcattccttaagatgagttatgcatacagaagtaatgattacatttggtatactttctgtgtgtctaaaatcacatataagaacataagaaaacatacaaaagcaaatgcttgggatttttccttttggaaactccactagccaggttctgtaagataacgcttagtaattaaggaacacccacttcgtgagtattattggtttcaaaagagcatggccactgttcattcggtttgcctaagcattggccaaagattctcctgctgattgagcaacaggacaggaacctagcagattaattccagcgagatgaataaggaacattgtctttccagtttttaaagaggatgtttctgtggctttttttttctttattatctacattgaagcatgatcgacagattcttatcaatgatttccttgtgaaagcagagtcaagggaatgaatagcgcaaaccgagaactgagaattttcatcaaagtggaaccaaaagttagcctgtgtatggtcagtttgtgtggcagcagtgctgttctatccttaagaacacttctattcagagagaatcgttattagagaggacagatctgtaagtcactgggtgaggtaacatcagaactgaaggtcctctgaaaatgatcttatttccctttttgtaaacaagaaaactgtgcaaaaagctccatatccctttctctgtttctcgattactttctttttaaaattactttagattcaggggttacatgtgcaagtttgttacatgggtgtattgtgtaacaattctaaaattcatatggaaccaagaaagggcctgaacagctaaagcaatcctaagccaaaagaacaaagttgagggcattacattgccccacttaaaatatactacaaagctgtagtaacgcaaacagcataatactattacagatatagacacctagatcaatggaacagaatagagaactcagaaataaagctgcacacctacaaccaactgatttttgacaaagttggcaaaaataagcaacagagaagggacaccttattcattaaatattgctaggatagctggctagccatatatagaggaatgaacctggacccctacctttcaccatatacaaaaattaactcaagatggattaaagtcttaaatgtaagccctgaaactactaaaaatcctagaataaaacctaggaaaagttcttctggacactggcttaggcaaagaatttatgaccaagacctcaatgacaaatgcaacaaaaacaaaaattgacaaatgagagttaattaaattaaagcttctgtacagaaaaagaaacaatcaacacagtaaacagataacctcctgaatgggagaaaatatttgcaaactttgcatctgacaaaagaataatatccagaatctataaggaacttaaacttgtcaacaagaaattaaaaaaaaacagattaaaaacaggacaaagaacgtgaatagacactcctcgaaagaagacatacaagcggccaatgagcatattaaaaaatcttcaatatcactaatcatcagagagatgccaattaaaccctaaataagataccatctcacaccagtctgaatggcttttgttaaaaagtcagaaaataacggatgttgattgctttcatagggtgaccatgattacatttgtaatagtcattcactcctaaggatttcaaagtcatgtgggtccaggatcctcaatatgaggattaatgttaccatgggaaccatgaaaagagctgacctaataggggccatatcaattctagccaacttcttgagcttcctaatagagaagaatgcctaagagactctctcaccaagaggaaggcaaattaactagtcagataaatgagagcagagatgggcaaactataattggtaggcctaatccattcagccaccttcttttgtacagcccatgggctgaaaattgtttttatgtaaatggttggaaaaaatcaaaagaagaactagatacttcaggacacataaaaattattaaaaatgcatatgtcagtgtctgtacataagactattgaagtgtatcaatttatatttgtttattttttctggctgcttttgtgctaaaacagcagagttgagtaattgtgacagagactgcatggctcacaaagcctagaacaactactatgtggccattcacagaacatattcaaactcctgaactagaggaaagctaatatagaagcagcaccctgtttgaccatagaattttgccatgtcttcttcttgaatgagtatcagaggtttgacatttctgggatccttttgataggccagtggcgttgtagaattggtctttcctaaatagaatgattcatctaagttttcttcctgctcagaattaaatagtaacatattccaaaccatagatactagaatgcatagcccttccaaaagatactgggtggtgcgtgacacaatttaagatgtttaaagataccatctacttgaagagaattacgaactcaagaatgtcttaggtattctaattcttaatgatcccacagagaaagaatgggagaacttccagaagtagtgaggatgtggtcaggggtgattaactgaagggacagctgcaggtaagaaaactgtcctgtgtccccttaccctgtgaccatgtttccaaattatagttacagaaaaaaagaatatattttaaaagtattccaaattgtttaaaaggtaaagaaaaatttttaaattaaaatgacaggaggaaagccatttgagaatattaacaaatgagataaaagattgatgatgaaaattgacaatttaaattattaatgctaattgcaacttcctacagcgacatagccctttcactgtatttttaaattcacccttcaatcagagtagtattaaagagggtaaaattaatgttaagtttttaaaaatatggatcaatcctagctagctgcatggtccagacaacagcaatgccacgaggcagccatcacagtgatatttatcaccccataaatgttcagatacttttccttttctgttaatggaattttctaggctgaggtgacaaacactgatagctgtagaatagagatgatggaaggaaatggcaaggcaatctacaggagattactagcacctgaagagtttgaatactggaactgcacaagttccttgagctttcatgataacccctactctcttggactgttatgtaggcaatagtaattcattcagcaaaaggacagggaaaatgtgtattttggtctctgatatttcccatgtacataagatattgcctgacacataggacatactcatgaaatatctgtttaaacgtaacttgcaaattaagagttgcaaattataatgacaaagcagttcttgagagaagagaaaaatgctgatttacatttaaaattgtacaagttttataacaaacataaataatcacctgatcaaatgttcccgttttatagatgaacaaatacaagtcctggtacatagcaaaactgtaatactatgcctgatttcaacagttttttccactataccaaattatcataagaagtcttattttctagtaattttaaagtaatctaagcttaaaataacaaaaagctacttattcacaataagcatgaaacaaaccatggctaaatttcaagtgcagaaaatataagtcctcattaaaataataaaatgaaaacccgtgtgtatctatcacctactacagtctgtagtctgtccccactgttgtgattttagatttcaaatattgtttgttagtatcttaatatcactctgattagttgagtgtaagtaaatcaatctgaacatcccattactggccaatattgtttagcatatgaattgatcacgaaaacataaccataggaaagtaaatatgtatgtgattaattagaggtttacttccctgaagatcattatgtttgggaaatacaagctttgacaaagtctaatctatatgattttctgatttaatcactaacattttatttctaattttgttttaagcatcaaagattccaactcagttaaataatttagttccattaaacccctaaatatccatggtgtcatctgaaagttcaaatggtagaataagattttctggaaaaaaaaaatttggtcctatagtatgttcatcctaccgcctgttttattaacagtagtcttagtatgccaagagttgcctgagaggaacacacacaaacacacacgcacacaaatggtattaataaatttaactgaaggtgttaaatgcagaataatctatgtctaaatagccacttgtttaacaaattaccgtgtttttcacgtttattttggaaacaaagttttataatatttaacctcaggaagaacaaacattggttgctcaattatcctttggctttcagttcactcttagaatttaatgactatcactcaataaaaactcagaatgcatctttctgtttgcctgtggttttcaacattggttgcacatcaaaatcacccgagaaacttgaaaagtatcccaatgtttggggcccacttccagagattctgatttaattggtctaactctaactagctctcttattcagcaaagttgagaatcactagataatgtgatacaagatccgcgaatttcaagctgtctgacgagagcctaaattcagctcagtcaaccatgtcttgtatatatattttttataacagtaagatttcacagtttaaagagatctggtttctggtcctagattatctggataactgcctcaactcatcattcctcttagctataaaaatataagaactattacttactctaaagtctgttatactctcattcccctgaaaaattacgtatcttttttttttaaagtgagcagagtaatttatctgtgaagtgaaataacactagcagatcattaacttggtgcaatgaatgcatcaagcagctgttacttagaaaatagaacatctgttacatgccattggagtcactattcactgtcattatagttagagctgttatttctgttcagttcattctgctttcatgaaattcttctttaataaacaatacagtgttattaaaaagtcaatacacattgctatagaatccactatttaatgctttatgttctttttgaatgtatcattatattattctgtcacattagcctaatagtaaaatatgtcctaaacctctagccatgatagagtaattttgggggctgtaaaagcaattagcatctcatttcctcatgtttaagacatgttagattgtgtgatgcaccattgatatgattacagctgctgagaatttaaaaaaaaaaaaaaaaacactaccactttcaaggtaaaccttaattgtatgttacatctcaatttccgaatccttaaaatgtgacaaatgcacatcttagaattgcagtaatatggcaatgtattccttttctttccacgaatatgttacgtagctaaaaggtgaaagaaccctctcctgttctctgtgatcagaaatggtataatatttgcaaatactaagtgcagaattcacctgggtagggggacttctcaagatgccttttatggatgctttagttagccttttattcatattacagggaacatgagtaagagaaaggaatagctaaaataagtctgaatttaattgagtcctagtaaagggaggaatctataaggaaatgatgttaaggtacgtaggtaaataaatgtggtgctgattgaagataagctctagagaacaggagactcttaagataataaaatttgtttaaaaagagggggtggaaaaaagagatcagacagagaagttatcttaagaatataagtccctgagaaattccaagaaaatctgtggaaggtactggaaaacttgtgaaaatacgaaatgggtggaggagagaatagaggttaagtgagctacatttctttacccctgaagggaaatgtttgtaaaggtgttcctataggaccagatgatttttccaataatttttaccgttctaccattaaataaaaataatgaaaaatgctgatggtataatcagcagagaccaatggagaaggtttttccatcttgctactgtatcagtgaagtgagccgatagctgaaccctgaaccgaacatgcctttttaaatttctacaagcaattatacttgtagatatggggaatgaatcagaatgtattcttcatccttcccatcaacatggggcatgacttcactggaagaaattaactcattatactcattcttttataataaggaaattagagtagcatttacaaattatggctaagaagtagacagcaaatttgtttgaaatcatggaagttagtgcttagtatttggactatttatactggagctatcaaatgttacaaagtaacatatggaaaataatatgttagacattgtgagaatttatagtttaattggattttacttatgtcagatattttcccctctatcataaaaacccttagtgccaagtatatagtttgcgttcaccttctcttgaatctcctgaaggtggacttacaatcatgtcataggtcaagttaaaactgagtgtacacaatcttgctttttcttcagccctaaaatcgatcctagcagcaatcacattactacatgactgaaaaacctaaagtgtctgagttataatttagtgaatttagtcattgaatttgaacttgctccttcagaagagtagatcttctagaaccctctccacttctcacctcacaaggcagaagaaggcatgtatgctgagaatcggatgcttttgaaaaggaggaaatgccatatcttttcagctgtttctttccatctcgccaaccctataaataaggagctccctttgagaggaatgagtacaggtataaagacaatggccaaggcaatagctctaggttggttctccatacatctgaagatgcagacattcttgtgttgtgggaaactattagagccagagaaaatggttcgtcaacaacctcatcaaatgtattcttttagtttacagtaagaattccctgttcctctatggcagccttgtattctaactttcataccttctcgttgcttcgtactttgtctttagtcaatccaaaccatcccatgcacactccgccttcaagtgtcacctttcccttgtagtcattcatgcttattccagccatggctcatctgtttccaaaaaaaaatgtgatttttttctagtatgatatcaaattgttttattgcatttaagctttcctctgcagctacactgtaggcatgattagagtgaggtttgcaaagattacctcattcctcatctctggcagtgaatagcacagtacagactggatattaggcacctgatatacattggtcaattagtatttcagatctccagaaagcaagctcagcatagtatttaaaggctaagtcttatttaagtcttatttcttaagtcatatctttgattaaaaacacatttgagggaaaaatttaaggcctactaaattaacacaatattttttcctaacccaaaacagcatgtatacaaatgattgaatactggttccttattgttgaatagcatacataaaagtttaactctaggtctctttttttacagagtgtaaattgtcctgtgaatcacttttgaccattagcagttataaaccaccatcatatcactgcttttttcaaatacaagttgataatggtgataaattgaacatcttttagttttaatttataattttgtggaacttaagaaggcactagaaattagtccacatttcctattttgttcccatcaactgaacatcactggacattgtttaaattagctggaggaatttggccagatgttgacacataatggtttctgtgacccaggaactacctgcaacattatcccctaagttcaaaacttttgtgatctcttctgagttttggaaaattccattgcctttaattgcattgcttgtcatgtaagaaacaaaatctatgtacacaataactttttacattgatgctaaaatatagtgtcatctttatgaagacttattaagagataattagtaatccaaatataaattaagcttcaactttgtgaagggttacctttgtgaataaatcaactacagcgagatgccagtagactggaatatagaaagtagataattctcatttgcgtatatgtccatctctttgacaaactcatacttggatataagtttttgaaggatggggacttctctaccgttttatcccacagagcctagtaacaatggctaacatctatggttgtagaggttgtatactacaaaaggttgaagtcaaagtattaaaaggaataaaatctagtctatgtctactctgaagttaagctctaaagggtctgtatctacccaaatgagagacttctaataatctcccagaatatattgaggagaattacatatgattctgctacagtagtaactggcatataataggagctcaggcaacacttacgattgataaatgaagaaattgcttttatgaattgctaagctcacctgtgtgcaacaaatagcacctacatatgaagaaccccatgcatgatagctgtcgagttcatctggcattaagtaccttaatttcaggcatgtttttattgaaaaaatgtgacataaaaccatatcttagaattgaagaaacagtgtttttgtcttgcataaaaatttttatacattgtttcctcatttatttctcctgtttatccgatgccaaaggcaaaaccaaaacagaaagtatgagaagtgatttcgagtggaccaggaccttatggcgtggcagaaagacagccacaggactacttaggtatattataaagatagaaaagacatgttgagagtgactctatgaggccagcctatacctaatttcttactcttgtactgtaatttttttcttaagaaattagatgtaggctggcattacagagctgctccttgtgtgtttattaattgattatttgtatctggactttctccactttcctgttattgctgtttctcaatgattttgttttgctttggctttctgtgattaagacatcagctccactcgcaaatagcttttcaactcgagtgccaatcacagtctctgtatctgttaaccttattgagaaaggagaaaaagggtctgttgggctctggctcagctctctgtgaatgtcccacagctggctaactagacaggcagggaaagaaccaggcacagactcagtggaatgccgagtggccacattgtctgtcagccgtgccatgtaccaggaaaggggctttatgcagggcaggtagtaaacctttgtactaagatcactttttccatcactactctctatcttttttcatgttaaatgtgattgttttcatgttttataaatcacctcttaggaaatagtggtattctcttaggagattttagtctagggtatgtggatagaaataaggtctgtgaacttggattgggggaaaactttatctttatttgtattcaattaaaaccaaaagtaagcagttttttcagttaaaatgtgagcaacaaactccagcaatagagatacccatgactttgtcactaatagaaatgacagatacttttataacgtgttccagacattgtacatacttaaaaataccagttatgctcgtcatcactacattgaaattatcctaaagacctgatgctagatcttgttaattaacatattaggaaataaaacatgtattactacatcacaaatatttaaaaaatgtgttgcacattgtatttcagtataattgttttcatttaaaatcctatgtattttgttttatgcatttaaaagcattattatgagaatgggtttttaagcttcaacagatgccaaaaagatccatggcactaaaaggctaaaaaaatccctgctgcagaaatacagtagcaccatactgtagaattttctaagggcagtttcttatttgtggatggattttcaaatatctgcctttagccactacatgtataaattaaataaatataaatatatttagttgaacaatatgtatgtttattaaatatttataatgaaaaataagacatgaattatgcttatgtacatatatatgttcatagttacccaacaatgaagcttcagtatatatggtatggttttcatgattcattaatacatagttataggtttaaaaccttgcagaatcatagtaaccatacagaaagccgtttcataagcattaaatcttaagactacaagacattacttgaaggtcaatgctctccttttcacaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggtaagagaaaaggctagaagcttttacacccttctctgtcacgagaaaaagatacataagtgaccagtaacaattctgtgtttgaaaatttctcaattctacgtatatgctggctcttaattcaatatctataacaatattttaatatatttttctttatatttacgcaatattctatatgaaaataccacttaaaactaatctcaatgaaactttattgttgtcttttaaacattttagaacataggaaaaattctttaagaatattgtctaaccaataatgccatggtatgtctctgtacaattaaggaataccagaaacacatggaaacttttgaccagaatgtggaccacatcacaaagtggatcattcaggctgacacacttttggatgaatcagagaaaaagaaaccccagcaaaaagaagacgtgcttaaggtagcaaataaaatatgaaaagtaatgtccaaattgtacaccagttacttcaatcatctttgtcctaaaagatactaaggacgtcttaataagagtaaaacaatcctttcttccttcctttatctttccctttttccttccttccccctttgaatggaaatgaatgattttgaagagttctgtaatctgactttctgttcaaatccatcactcagttaattatacccaatgtaaactccgttcagaaagatattccaagatttattttgaaatcatattgcaaatttctgcctttgtcaatggtggtactacattcttgtgtctaacacaaagaacaatctgacactatcattcatttagcccatctgaatgaacacctgaaatccagtcagctgatttttttgcctatgccatatccaaatcttggtaattagtcttaatgttgggcttatgtaaagctgaggttttcatttttaactacatgtaaactaggctttgggttctttcttttagtctcaaaactgactgttaggatgccctgtcttctttttcaaggggaacttaatcttttctttaaaaaatgattccgataaaagggtatgagaggtgtaatacgcaaatataccttatagacactacattgtttctatttgatgatgtctcttttcccaattaaataggtagagttgaattttaacagctctcttttcaataaacattttttattttgttttgctgcaatgtttgataaatttattgattagttgtttactatttaaagaaaactcaaaaattatgtttctttctatgcaatttatttttatgcctctgatattttccacagattacgatatacctttaatgaaaaactataaattcattccaggctatccccaaaacacatttatgccattgtctgaagcttattttgatgtggatctgtattgtgctcttcattatcccttgatgtatagtcagagatgtcatcttatggtgaatttccttcaaggctttttgaataatagggtctgagttatttaacttcaacctctgtgacccggcaggtcaggaagaacattcctcagtacctctgtatgtgacagaaaattcgtatgtgttagaaaatcactttttttcttatgacactcaatgtaataaagaggaacttgaaagtgctaggaaggaatagaaaagtgttcttcagctacctgacctcctgagcacatacttagttcattccacaactattaaattcagtaacgatataataaaataagactaaatagaatatattatgatagttgcaacaacatagttgggaaaacatccctgtccttcctcggactaaataaacattttaaatagacatgcatcaaacttaaggacggtgatctatttttctgaaatcacacgcattttcattttagtcctgttttatggaagttgtggttttatctccctttgtattttctgcatgtgcttgctctcattttcttactttctctctctctctttctcactcttctcgctcacttgctcactcgctctgtttggctctctttttctatcttgaccttcattaattactaacttcaagtcctatctcttgctcatggaatatagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggtaggaagatctactccaaggtggaaacttgtgctaaatggtctcttgcgaaggttgcgcagtactctgaaaggggcaagtagaccccacagcaaggttttcaaaaggaaaatgaatgccaaaatgtatttaaggaaattttaccactgattataatgggagataaacgccactcctccccgtctctgtctctctctgtctctctctgtctctttttctctctcatcttttgctgccatagatattctaggactgcattctatgctgcagtttacatacgtactttcaggggtcacctacagaaaaaaataacaaatagcatgctgaaggccaaaaaaataaataaaaccaaaagcacacaagtcatccatcaacataaagcactaccgataaattttgccaaaagcagtactgatacaatattgcttgtatgtaatgtggatcaaatatccaaaatgaggtcttgtacatcttctgcacggtctagggtgtttttttacctctttactggttgtgcaagtgtgtttgtttaacttgcttttgctagttgtagacactgtgacaaaattcattaggctataatgaaatgatcacgccatgaaaacaaatcattgcaaagcttacatatcctaatttttgtaattttatatgcctatttatattactgtttaagaagaaccagggaatatggaacttttgcgtgatagactttatatttgtgtatgatttgatgaagagaaagtcttatttaataagtagtttgcaaaaatgtataaatatagtgttatagaatttcagctctttgggaagatttgaaatgcaagtaattacctagaaatttatatactgtagtttgataaatttcaatatatatgatatgctttcaaacataaaaatgtatataaaatcaatatatgtatttaggtatatagataattgttagaaataatctgaaatgaaaaaaacattggagtatttatgagaaaatatgatgcagtatgtcaggtaagtattgattcctggaaaaatagaacattttcaaaaaatattttgatagatataagcaaccagtaatagcatggtttcacaattgctgcactttctaaggcattacagtgtctcatcatgttatataatagtacatatttaaagtagttttcaaaataagtgaaatgtgacatgataaattctaaatagtttagcttgtatgcatgagacacagttacccttcaaaattcaccttcccaaattaaaaagttgttagtttaccttaattcattgcaagttatttttaatagttaactacttagttctcttgtactctctctctccatacatagagaccttatatagttgacttttaaaaggctatattctctacatatggagagagacagcatgagagaacttagtagttaactgtcacaaatatatatatttgagtcagtcattattacctgcaaaaaaatgtgacaggctcttaaaattgattaaagttttgaaagaatgtattgttacttacaaagacaattgtttttacttctaaagatatcaatggcttatgtaataacaagacaatgaatggagatttatttcaatccttaaaaaatgctactacttcattactaagatatagacacacacacatgcacattttaataaatcactaagctatagaatatttaagagaaaataaggtattatctttggataaattgtgttacaagattgtggttcacagatattaaaaaatgggtagaatttgctctccaccacagatgtgacagacccagccaatacaagtttgtgaccaagacaagtttgtgagttttcatttcacattctgcatgaatttgtaagtatacttctggaaatcatgcataaagtgatccactctatgaacttcttttattttccctagaaacataaggcataagaaatttccagtgaatattcatttattattattattattattattattattttgtgtgtgtgtgtgtggtggagactctctctgttgcccaggctggagtgctgtggcataacctcagctcactgcaacctctgcctcctggaatcaagtgattctcctgcctcagcctcccaagtagctgggattacgggcgggcgccgtgacacctggctaatttttgtattttggcagagacggggtttcaccacgttggccaggctggtctggaactcctgacctcaagtgatcctcctgcctgggcctctcaaagtgctgggattacaagcgtgaaccactgtgcctggccccagattttcaattatatgttaattaacaaaataatcacatgtttgcttttcaaagtatttgtttttctctaaattagtaaaggcaactgagtgtaacaatgaccccattttagggctctgaagagataattatgctctattatcacgatgaaatgaaaaacacagaaataaagcatatctgacactttgcttatatattcattgcatcagctaatgggattgagcttccattgtgttagagattgtggtgagaagatacaagggtataaagatccttgcttaagaaatacatgttttcaaacagaaatgaatacttagtataatcataaaatatgtttaacactaattcatcttcatggggatgttcaaataatggtgagatgatctcggcagagagaacaatagatttagaaggtaatctcaccagagaaaacagtggatttagaagattgagatttaggcctaactttttcagtagtagccagaatatgtgatttttctgcatatccatttcattgtttgtaagatgaggaagttaaaatagactaacaatttttaaaagaaaacctatcctgcccaaaatattattatttaaaataaagtattaaatttaaatatttaatattaaaatcatattatttaaaattaaattaataaattggaaaataatagagttactagatgggggaaatatctgccattttatctttctccttcctatgattgaattcaggaagtataaattatgctcatagaacatggtttgaaatttctaaattagattagttcataaatccctgctcgttctaaaatttggctattcagtaatcttttgttgattacaataagaaattgaaaacatttaatgtcttgtgtgtgtttgctctggagtagggaagtgctgaagtgctggaggttttagggggtagcctttgatctcaaaatcaggtttctttatagtaggggttatacaggataatattaggttagaatatggcttttctatggttgagtctatgtctaagtttcatggaagagtaacctggggaaaaaaaatactatggtgataaaaaaagtagatttggattgaacacgggtaggtcatagactctttgtaatcagtaatttcagtatagcctttagaacataactctaaagagcccttgaatagagaaataacttatgctgaaaattcactggtgtctagatttactatttggtgaagaatacaaagtggggtactcccatgtctcctgccaggactgttcatgacaagaaattccgaagcccagaaagcagtgagtaaagggatcctcagttcagattggctgaggacttgactgtccaagtgcagctctctgtaatgttaattttggcctcagcaaggagcagtatggtgagagcaaaaagtccttaacttcaagacacaagacctgctttgagcactagctgagcacattactacttagtgattttggatatgcctctttacctctcagagcctcatttctagctacaaaataagggagatgatgcctgttttattttaatctaaagattgtaatgaggatcaaattatgtaatatatgtaaaaacatgcatttaaaatgtattaatcagtgtatagatatgaaatggttaaaaataattaatatcaatgggtatttccatcgttacgtatattacacttgaatggccgaatctggggggttgagacaaaaactgatggaaaaaaatgaaagaattgctgattttctgtggtctctgctgtaatcgactggagtcagaaaatcgtgtctttgctattttcatgacaaagaccagccttaaagataatgaagtggatgaatttaagaactactaaggagttatgtttgtcccacatacgccccttaaaatacataaaaatgctgccttttcccattttattaaggttacctaagagtatccaatgactttgaaaaaagcgtgttttttcgtaatctatgtgaaatcaatgtgaggaaatggcagttttaatggagaggatcagaattgcaacagtcaatcagagataatattagaaccctgagtaaattgacagaatcaatgaggagagactccttgtctcaactgtctctgttttagggcatcggagtatagtggcatggctgagggcaagtggataccatcgggaaaataaggtgataggagacaaaagtataggaaggggcatgggaagacaaaaataaactgattatttattcatattaattatgacagttctacccctctccatccctctagaagccaagttggagaaggggagtcagcaatttgggagagatgctagttgaggtatatctaaaagcactaatgagtgaagacttgagaaaagggattaatcaggatgaattctcaccaaccatatattattttccgataacagtgtttggtagtgagggggatctattgctaggtaaaatacgatggattcaaggagcttactgtttgatgatagggcaagatgtgttcatggatactagattgagagtgagtgcatggtaagtgagtttagcagtcactccagcaacacagaggaggtaacaattcggcataaacatatgagaaagcttaggagcatacagtgtgttcaatgaagagtgagttcctttagttttcagagtagagggcatggaagataaaacttagttgtggatgataaggctgaagattatggctagacacagtgtgaagaggtcatggacagccagactaatcattcatgcttaattcagtatgcaatgaagagttcttgatgtgctctgtgtgtgtgtgtgtgtgtgtgtgtgtgtgtgtgtgtgtatctgtgtatgcactgttgagaaattagtccagtgatagttgtgaggagaattccactgaataatgacatgaagttcgggagctattgcagtagtctagatgagatacactgatgacctcaaaaaaagggatagctatgggagtggaaaggaaatttcagtctagatcagtaaatcttttgtatgcacttgggtgaattgttaaaaccagtgtgctgggccccacactcagagcttctgactcactaggtctggagtggagcacaagagtttgcatttctaacatttttctaggtcagattgatgctgaaggtctagggaccacgcttagagaactgctgctgcggagatatttagaggtagcctagagttaagtcattacatacaaggacccaagaagatgatgaattcaaaaatgactccaaatttaactctgattgactaggaaagtctgcatataaattccaataataggcctggtgcggtggctcacgcctgtaatcccaacactttgggaggccgctgcaggcagatcacctgacgtcaggagttgaagatcaacctggccaacatggcaaatccccttctctactaaaaatacaaaaattagctgggcatggtggtgggcgcctgtaatcccagctacttgggaggctgaggagggaaattgtttgaacccgggaggcggaggttgcagtgagccgagatcgcaccactgcaccccagcctgggcgacagagtgagattccatctcaaaaataaaaattaaaaaaaatttcaataataaaatatgcatcaagttatatttttattgttgtaatacttagctgcaaaataattttgactaaacaaactttaggtgtgtcatattaataaaggcaattattttactttttacaaaatattatgtaatttctacataaaatttgcttagattgtatttttctagagatttagatatacttcactgttctaaggagctgaaatgttaaattatttattctgaaattgatactaaccagaaaaaagtgaaattattttctctgactttgatcctttactaagacttatttgctataggatatatctggcatatgttctttaatttccatataggccttgaaaattgctgctaaaattcatgtagcagtttctatatatatgtattacaactgtaatatgagatttggacaatcgggcatcaaatacttaaatattcattgtttgattgctgcaataattgtaaattaccaagtttttttttttttttttttttttttttacttccattcagtgtcagaagatataaaagtaatcattctttggataagagactttcacaagtttataggaggctgtgagagagtcagtgaccttcccatgtaatgtagaatatataagaaaaagaaacacatgattgggcctaatctatcttaaaatatggttctatgtgtggaaaataattaagcagtgatttaattattttggctctcctaaacttcggtgggaaataaatgatgcattttataaatgtgatctagaaggtccaatgaagatgtattggattgaaaatttttaattaaagcttaattttctgtagtcagatttatcaatgcaaatacattgatattttgcagtctctttctgatcgtattataacttaacacctatgatggaaaataatattgtatcttaattggaacagtattcttgctatatatattctttaaattttaatttttttaatttttgtaggtacattgtaggtatatagatattcatttttagtaaaattttctataaaaacatgaaaactgagatgaagacttgtaaatattgcataatttgtagagcattaaatatgtaatatttacaactaatatcttcaggtaatagtaacagatcactagtcaaactgtataatatctgcaaattttattttactaaaatgaatcagaaaaatatgaacctaacaacataattcttatgttagcttattttttccacatgtgtaattggttatccctataacaaggttaagtccattgaaacttcgctaataaatccctttggtaaccatgtaaaatatttttaaagtagatgtgtaattgagtttggtgagcagtgtcatttgataaaactatctgggtcttgttagcataacatttgaaataattaaagctatttggtgaatcttgattgttctcctttgataaaggaaaattagtcccctgatcagtgtcagtagatgtaaagcaattttgctttggaccagagactttcagatatttataggaggttgtgagagtgtcagtgagttgaccaagttctcacagttagacagtgtggttagcaaatactagatctcagtccattgctttgtccacttcaatacactgactcagcatagtttactgcctctatttatgtcataaagtagtttttgttggtctactatgtgttagtataaacatacccaatttcacttcaaatacagtgatttcgttatactttttgtattaaaaatgacaagaacaaaaggtggtagggaggaagaaatggaagaaggaagggggaatggaagaaataaaactggaaaacaacctaagtaaatgaaaagaaagtttaaaatacaaaattgcttaaagtgttatgtttttacttttgtctgtctcccccatacattttagagttaaatgttttcctcttttaattcatttcctactccaaaaagtcatgtaatcatgaaatagggcaatattctaagttaaactttataaaaggtcgacagtaggaagcagattcttgacccacgaatatattttgcatccagttttaaaatgtgtaagcatgaaattaacctcatccatacaaaatcaattgaaatctactgggtaatatcctctaattagcctcacaaattagtcacattttcacatttttattatcaaagcattaaaggtaaaccagtactttatctattctcaaaagaatgcaaccaatgaaatgtcactatttggagtcaatttatttaatttaaaaataatatttcttacattttcttgtttgctctaataattttaaaataatagaataaataagtttataaaccatattttaaataatctttcttctagcatagatgtagtatctttccaatacacttatttgtttttgtaagttcttttcctctacagatagaatgatgtgaaataactcttcatatcatatcagtagtctgtcttttctgtactatagtgtgttacttgtccttgaaatttttcatcttggtttccatgaattctttatttttctatatcaatattgtaatgataaataaattttcaaagctgcagaatggaaaaaggagactgatggatttgaagcaattttaaaccaatctgtagcacttggattatttattttcaatttaggttttagtgtgatttgaatatagtggtaatttatcatgattattaagattccatagtccagattaacaaatgtttacttgctgtctgtgtaaacacagtcgttattatgctagtgtatctgtgcatgccaaagtaatatttaaccaaggaaagcttacattttaaaactaataaagtgtatctgagtaattttgaatgctttcaatttacaatgaatcagtttgtaattgatcttgcttttcttcagtctgttatcctttgttaacttgttataaaattcagctttaatgccaaaacttcaacaaagccttaaatttcattaatccttaaataatccaacaaagcacaattaatagttgttaagcaatttgaaacattaaaaaatcaaggaaaacaaagtgttgtctttctcggtttctctgtctcttctttatgtgtccatttatccatttattatacttccctgtcttctaatttatatgtattttgtatgactgcacagtcatgctaaagctcttaaaatgaaaaggtaagtaaaaaattaaaagtgtccaaaacctatgcttggtatacactttctcatgcaatattataacttttgtttgattattttctatataactaaaacctattttgtgtgcactgtctaacattgtgtgatttaattgtgattccagttcttttgtggtcatctatttcctttaaagtcaatagaagtaacttacccaataattaagatgatttatcagccattgctttcaactgttttagacaatttatcataattctgaattgaaaagcaggcatgatatactttgtgttttaaaatttggtgactcaagaatgagctgttaaattataaacgctttcttattacatgtttcctttataaagttgcataagaattccaagttacaaagacagggaagaccaaggaatgacatgtagaattttaattgggtgggaaagtgttttctgttttagaatgggcatagcctaatgctgaactagtgaactcttaagaaaagcaatgaatttttttcatctctttgtgtccaaagactattaatcatatggctgtcaaatggctggtgctatcttgccaataacatagctaaaacaattggtttgataaacttattttggttataaaattggtcactggttgattaaattaatatataggtagttctaaaactaccgattgatataataagcaccttttcctgtataaaataaaaggcagtgttttcactggaaaatagagtagtataagacatattgccaactttaaggatggaaaatttatttagagagacaagcatatatctttgaaagccaaataatattatattcctgtctataagaaagcagtgcaacacaagctgagatacacataaatgagaatagaaactcctgaaataacaggtcaatcccactcccgtaatttttcctataccccgaggactgcctgaaaatttcactcagaacacataatgcaagataataagaccgacgtaagaataatctaaattcaccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttttgcccactgattttagttaatcactttgaaactacacaaaataaaactactcaaattcttaatcttcctaatttttttaaacaaaatgcacggtagtctttcattggaaaatttagaccctacacattgaactaaagaagtctaagtttccattatcttgcctgaataattagcacttcagtttttggtagtctctcccaaagctctttttacatcttcccccttttttgtgtttacctggtggtatcatgttgcttagcatttgggcagcagttaatatacatactcatataatgctaaccagtcaggtcttttgacatttctacatagaaattgtgttatttaaaattccatgtcactaaaaaagctccttgaaatgtctattttggccctcaatttttagtcttttgttcatttattttttcaggaaatatttacttatgaatatttactatgtaccagaaatgactgtaggttgaacatgagaaactcagctccataggatgtctagggaacacaccccactgactgtatctgtggtatgccttttctgtctccaaataattcctgattaaaaaaaaaaaactgcaccctgtaaactaaatgcaaggctgtgatatcactttttatattgccgcagataaattaatctgtagttttgttcttcaggattatgtaactctaccaaactggaatctaaaatcctccatgttcaccattacaatgttatgatttcatcaaatcccttggtaaaataaagactcattatatcaataagcatgtattttatcctttaaaaccatagatttcaaaggaggaagggcttgacctgagccaatggatgattaggattttgagaggatcaaaataagacccaagatttatagagcatgtatttatattggatggacacatagaagtttgagagaaaataatagtcaacatttattaagcttttattatataccagacaccattctaacatatttgatcttagtaatagccctgtgaggtagatattcatcttatctccatgttataaagaaactgaggttcaatgaggataaataacttgtctaagttccctcagctagtaaatggtagagcccagattcaatctatgcattttcatacagaagtttatgttcttcactagaagatgaaaagtattctaaggtcattgaaggaggcataacagaagatcaccaaatggcctgcaaaaaaaggtctatattaggaacacttacataaggctggcaagtctttggggcaagattaggagaagccttgactactgtgctggaggttggactttattctatttatactcaatagatgcaggaggttcttcagcaaataaatagcataatgaaagaaaggtttttgaaacatagtaagctgatcattgggcacaggctggaactggtttgactgaaaggagattttacatcttttcaaagcttattgccttagttttgtgtaaggaccaggaacgatggagtctctgggaatacaaagcaagtggatcatagcaagtcaattgacacttacttgatatttattagacattagagtgagatgttcaaaaatagcatgacttacgttttacgcctgaatgactgagagaaatggtcttccattaagagaactagggaagttagtattgtaagcagtttgcgggaaagataatgtgctccatactaggaatgtgaaacttcaggtgaaaattcagctggctattggagagtctagatgggaattcaaaagtcagataacagcttagggtgaagacttggaaggcataaaaaattgttaaattcgtagaaaattgtatcttaaattaatagaagttaaattcatggagagatgagctagagaagaagcagttggaataaaacaggtaaatctgactgtaaatagacctatgttcttctgacatccaagtacacaataaaagttattttcaacattatcattatgtattcacaaaatcacatagaacatagttgctttcattaaatattagcaaatgtgaacaaccatttaataacataaaatatcaccaaattgataattgtatagttatgattctaagggttgttaatctttttacttttaccgtcatctaaacagtgtatgattttattgtaccgtaattgctaataatacagacattgaaactttaagcatgtttgtaccactaccaatctatactggttcaaataacttatgatatttcaaatggcaaatgatcattaggatttaaaaactggtactgtaataggtcacttaaaattatctcataaatctttcaggggtgtgtagaagtacctagaagatatgtggttattcatgttgcatatgagaatcatgtcatcatgaatagaatttgattattcacttcttcaatagtgacagattattacctttagatatttagtttttcttctacacttatccgtattgttcaccagaagttgccatctaataaaaattcaacctcttcctgggaatgtgactggagaagggtaggtggggaccaaacttgatgaatgtaatcgtcttggcaaaagacacgggggtcattcctgaattggttttacaaaagtaaaatgttttagctctgaaagaaaatcagatttctgtatgtcatctatgggttttcaagagctatcccatataaaatatgttctagtgttttaatggaaagaaatacagcataaagattgagagagtatcaatgtattttattaacagaattttaatctaataactaaaccttgcccacttttttgaatatatatttgattttccatgtcttttcacttatcactccttttcaagggttttgtttagaaagtcaagagattttaaagttttcttagactggtcattatcagttcaaaagtaaagaaactgatgtttacaaggttgaaaagcatagattctttatgtgaaatatattaggttcattcgtttgaatttatttgcatcaccaaccaaactgttcctaaggcaagctaatggcattgtcttagaagagcatgcctgtcaattgtgctgtgctaaaaatgtcatttaaaacatctgagcagattgccatgtagtttttctaaggataagatgacaattctgcatttctacctgaggttactgttacttgataaatgaggcaatttctgatgagacatatttacccaaatgtatttatatcagaatatttaaaataaggtcaaatttgactttagaatattaaaaattagcccattcaaatgtatctgtaaattgactgttgttgatatcaccaaatgatgaattgtactatcttgcatgtatgttcagctctggtgatgtgaaatgtttctccttatttgcatcctcaggtacttttccagttgtatttcaaaacccttcataaaacataatatggaaacataatgcatgtgattagtttagcaacaggaggttgaataaatgtatttcttttggtttatgtttctaataaaaagtaattttgatttaaagtagcactatctttttttttaggcctccattcctttgaaggaattggagcagtttaactcagatatacaaaaattgcttgaaccactggaggctgaaattcagcagggggtgaatctgaaagaggaagacttcaataaagatatggtaaattggttgtgataaaagtgtgaatgaactaggagtggaaataaatatttggaaagaacttagataagtctccaactgaattttcagagcacatattacacattttatgattctaatgaattttataaatgcagaatattcttggccttttattacaaatgctgaattactatggtatggtaatataggagcacttacggtttctaataaatagcccagcaattttcttttgacctgacctacttttgaacttatcaagggcaaaatgtaattggaaaaaagagtcgaatcataaaataaactaaaaatttaataaaatactcaactatcatagatgactgacattttgtatcagcaatgtttttggtagtataacatttatttcaatgaagagagaataatgcataatatgaacattatttattacaatttcccacaaagttgttttaccaaatagttgtttagttagtacattatatgtctaaaatgtgtataaattcatgctgcttatttcatgggagtaaagaaatatgaccatgtgtgctcttcccaacctcagaatattctccttcaatcccaactaatttcaaagtatctactacatttctctctggcttgaatatttgtacatcacatccttattaactgactttttttttctctcttcatcctccttttcacaattttttcccctctttcactgccatcacctctgtggcattcttaacctttacaattaccagtgctagagccttctcagacaatgcttgaaagtgacatcagaagacaatatataaattttaggtaataagtgtgtgaagcaataggagaactattcccaccaatcttagttcccacttcctggagctgcctcaatcaatactccccatgtatggggtttggtggccttgccaactcagcttgtggaaagacggaagaggctttccaagttgctgagttacagcaatctctacttcaggtcaaagaagaaactagagggcaccaagatgaaaaaaagtactgattacctcttgggctgaccccaactctgccctagagccctcaactggtatagggaaagaagtgaagtgggttttttaattttttgttgtttttgtcctcagccctagaaaatgctacagacttttacaacaccttttaaaataagtaaagtcttttacagactataagtatatgatgtgtctatattatgataagtatataatgtgtctatattatgccgtatgtttctttagattattgaccagtctctgacaaaaataatccctttcccccatacaaaatgaatcagtcctcagttgcgtgttgaagtttatgcattatagatttaaatatataacatctaattccttgaattgtaatacacacatacaaatacttgtgacttttgaaatttattatttgttttccttatgtcatcagtgtaccttgagtaccattacaatgtgagactacttgatacaaagttttcacattctgagttgaaagaaagaaaactaaaggtgaaaaatcacatggtcatatatgcgactatattagaccagcatttattcaaaacattttatttctaagtaaagaaaattaagatattgttcttgcagcctaaaggaacaaaatacccattgaaaatgtttaaagccattttccagtccatattttagtattatttgatcgtatttaaattaacatgcatatatgacatattttagaaattatttgatggtaacttagcacatgatttttattaatatcctgatatttctcctattaatattgagcatttaggtttcagaaatgaagcaggagttattagataggaattagtgtacatttaaatcaaaatattttcatgtagttgtgtgttaatattttcagatttgctgttatctcagtcacaaatacacatctgtattcctttatggatcagttaacattataaatgataactttagctcatttctctaatgttttaatttctagaactacactaaaaaagccaaaagaatactttcacagtaattcatgacttgtctgacatgatgaagtaccacactcccccatctttctacaggtgcccctaaaaatgtgttctttacaactagatgggaggaaacttattttgaaacctcaagtaccaaatgtaaaagaaaggctatgagcacagtatcttataatagcattccatgaaagttttaaattggatttttgtgtgtgtttaaataacatgtcttattatctctgttaacaatgtacagctttttaaaaaccaaaatgaagactgtacttgttgtttttgatcagaatgaagacaatgagggtactgtaaaagaattgttgcaaagaggagacaacttacaacaaagaatcacagatgagagaaagcgagaggaaataaagataaaacagcagctgttacagacaaaacataatgctctcaaggtattagagctaaaattataatataccttgcctgtggtttttttttaatatatagggtaaaatataatgtgcattaataaaatctgcttcagacttagtcatcagaaactcactttttctgttcaatgtgtatgctttatttaacatttttgagtggtatttgattttgaacgatgtgttgcttaaaagttatggctttttaaagacatatttttctaagtagtaattgaaagatgggaatgcattcatagtacttatacatttaattttctaatgtgctttatttttatcagctactttatattgaaaaaaacctgcctaactgccagaataaccgatctacatgtatccattattcctgctttctttacttaattgattttgcttgcattaggtccaattttttggtaacctgatacttgtttaataagccctagattcttttatttatttttaaaactttattatgcctttaagaaagtcactctttgcaactatctacaaagtcaaatttcatttatgtaggaatcctaaaaaataatcttagtgcccttgaataagaactgctactttcatattaagcagtgtagtgtatggcttcaagtccccaggtgactcatctggtttgtgcaggaagagcaggataaacttaatttttctataataatatctaggaagttcttgagactagacatgtggaaagttttgtgaaactttttttttgtatatgctttgcaataatcactatttgcatgcatggctgattttctaatacttttaattgctgagcttttccttgtaaatcactcttttgagctatgtagttatgaaggtggatccacctagcaggtagatggagtctgctttctacatgcaaataagagaataaaacctttccccctatagtcaaccaaataaacactgctgagaatgtaattacacaatattgtgcctgcaaggaatccacaaggaaagtctaattggccagcaggtgttctgaaggtaactgctgataaatatagtaaacagaaaaggcctcttcctcgagggagtgcaaaagcacaccataatgtgtctagaaaatcggaacgctatgtaactcacacccttccaactgtgagcaagctttcagaagtatctacactggtcgtatgatggtgtgtgtcctactgaatagcagtgtttaatggtcatctggcattcctctaaagaaatctacatgacatctctaaatattttacatattatacatcactttgtgcttaggaaatgaaagatgtttcagattgatgaccaccaagccctttctcctggcaaagatgtgagttatgtcacaaataaggcatggctcaactctaattcacgtggctgtatcttgctacctttgaaaaaagcagcgttcgatctgactcctcagaaggtttgaaaattcaacataaaacataaagtacagcaaggtttaaattcccaattttaaacaaactagataatgaaatgtagttcattcttgcaaatacaggctataagtgattaatcaaaatcgtcaacactactcgccaaaccaatctataccaacatattcaataactttttaaacctgtcaaatagttccaattctggtccttatgaaatattttagagaaggtcaaaattttccaatggaatgaaatttttagaaattccctgatatttattattttttcgctcgaattaaacctgtgaataaaaccctaattgctactttctgtagaaatgaaagctgcatgcagagcttatgttcccatgaattataaaatggcattttgagtaattctattaatcacagaagatattgagtgtgcttgtaaagagcatgatgactgatttcctcccattgttgatttattaaattagtcttatcacattgatttgaaagcatgcacttgctgttttcttttttcaaatagttaattgttttgcatttagagcatgatttggtatagtaagataaatgtggctatgcaagccttggaaggagaagcatttatctcacataattttttattagttatgttcaccaatatacgaacagtggtgacacttctacacatacagcttggaacagtttataagacaactaaaatggctttatatttctaatcataaaatattaatggcctatgaaactcttatgtaggcatttctaaaaacatgaatgtatattggttgagtacataaagttttgttgatgagccccaaggctaaagatatacattttagaattttacctattttaagtcagatacaaactcactaggtttgtgagtttgtatctagttaagtcaattgtattcgtatattaaactcttgcacataaactacacaacagttagctcattaagagtcaattgaatgtgacaaaatttttaagcaagtttgaacatgctaagagaaaatactttaagtgtgttattcaggtttcttagcttcctatacatgggtcccgcctcatgcataggcaatttaattatgtctttgtatattttgcatttaaatatgattttaacctaagttgtacaaaaagatgagggacgcaaattattttgataaataactgcagccagaagtgcactatacatatatattgatattttaataatgtctgcaccatgaacaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggtaatgttgttttagaatgtcaataccagattttattatacagtttaattaacctgtgaagatcatatttaaaatgttgatgttcttgtttctattaacgttctctttgatttgatgcatttccttgtattgtgtgttgttttcagtaaatgtattgtattaagtgttattcaattgacgtaatgttgaatgaataaaatgttttagactatgtaaagtgatttaagaaatgtgatgtgttttctggtaaaattgtaattgactttgtgtatctttgttccagatgaactaatgacttatcggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaataacttattcacttaccctctaaattatattctatgtggacggtccctaataaataatgagttatcactccaaattgtttcaaatcccaagacaccagaggaatttagaagaaagaaaatgttagaccaatttcaatatttacttaattagaatatctaaaaccaagcattcaaaggataactgaaataatatttgggttattgagcgaggatgacagtcatgcctttcatatttgtaaacttcaaaggatgacaataaagggacaacagcctttgaaattttgagagaagtatttgctgcttgcaagtcggttgatgtggttagctaactgccctgggccctgtattggttttgctcaataggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattgtgagttgttactggcaaacccacgtatgtgtttgcaactactactctattaacagaggcctactaataaaaaaaaaagagacaaaaaatctgggtacagttttaaacttctaatgtacattctgaaagtgagtggtttccctcactttgggcttctgtaacactagtgcttaattttgccaattaaagacacaagaaattaacagataacagggaaaaccccttatcaaaaatgaaaatacatcttaattttttttgctacatcatttttcataacattggcaatgttaatttgtcaatttatcatacattcactttacttcaatgtctaatccaaaaaatatgtattgctttcctgagatcatcccatgctgattttactttcttaatgtatacatgataaataataaatatttcatggtacatcttatgtcaacctgcataagccattatctcattgacttgaagaataatagcttaatcctcacacctggtttaactacttaatgggttacagtgcccataaaagaactggatgcctagtaagatggttgctaattgattgcagattgaacaatatcagataatgttattactgaaatgttaccagccaaaacaaaaaggagtgactgctcttctttcaaacaactgaatggaaagtgtatggttctctctttaaaaaggcgattcagaattgttagcttggtctcacttctttatttgtagtaggtataaaccatagaggttttctgacaggtacatttttgttcctattattaacacttgtaagatgaagaggaatgatcatcatctgtaattatagaagaaagtactcctcacaaaaccaggatgtcaaaatctggaaactaagtctttatagttaagttaggttgaattatatgaatcaaacagatactcaaccattttgccctatgtaaataataactgcatagggttcagcccatgtatgagacttcttgggaacttcttctgtgatagtgtcagttccatttaatttggtgtatatttttaaaatgtcaaaagcagttaccataacttaattttataagcatataagggaagtatgttgcatattattgtgacttcttttaatacttcaagaaaattaataaatacactgttttctgttaaatctaataccctaaagtttaatagcaggtgaattattctgagcaattggaagaatacgagaaatagcgaaactgtattgcatgtgaagtctaattccacctggctgaatgtttcagcctattatccttcatattagatgttatgaatgtaatgtgtcataaataaccttacactaaccagcaagcctgtgtctgcagatgcaaaatgaagcgaaagattaaggcaatcaaaaagaaaattctaataaaatagtttcacctcaatttaatagatcattcaagggggagtcctttgctttgaattatctgactactaactcatttctccattccaattttccccaggtcttgacacacccaatatgcaggtttaaaattcgttacaaactaatcaagttgctaatgctttatggctaaataggcacaggatcaaaaatctccataaaccacttacttaaaatgccattatgtccctattcatagtaggctctcaacaaatatttgtacaacgtaataatgactggtgaaataaaggaagcatgtgtgaaccagtatatatttttaaaaaattgtagtaaaattctgggatatattttcctcataaacgatttattcttaagttttatatattaaagatccaaaattcagaatgtgaagggggctatttttgtgttaactcttaattatccatgataataaagtaatcacaatctgtatgaagaataatcaatttaatattgcagttatatttggcatcgtattttaattagaactgagggataattgatagatgataagtaggtatataggttggtaggtagatagatagacaggtgggtgtagaaatattcaagatacatctttatacttgaccaattgtcaatgcattttaaaactaatttcactgtggccactgattagagttatctttcccaattcttacgccctagagtcatttgtgatagtcacagtaacagcttaatgaaaagtagtatttgatataaccttacaatggctctgatgcagcatatgccatagcttcagaatttcttacctccccctatattctccttctctaattgtttgatttttacttttcctaactgtccctttttgtttttctagatataaactgtaggcttaaagttcatctttcatgtctttacagcaacatgttgaaatagtaagcggtactcttaaaatgcttagtatgtgagagctgagtgagtttaaaatgaaaaattaattttccttatctcacagataaagactcagagaagtgctaaccactgtaaaattaaggcatttaggggactctgtccatgtcagagctatatatggtagtaataaagctcagaaaaggactgagactttgagggaacaatcatgaggcagcgcccagccacacaggaatgcagaccaaagcatagtagagggtatctgcaaattgtggtcctcagggcaaacctggagatgataaagaaagaggcatgagactgggaggacgcaggtaaaaattttaccagatattcaaaatgagagaactcctgccttaattaggaattccaatcatttctaatatatttcctgttggtttagaaactaggttcctcagttaagaccaagcacggactgtaaactgaggaaaagggatagttctataggatgtactatcacagcagtgtggtctagtaaaattaactcttggataaacagccttgaatatgaatcccagtgactttgagtgctgtatgatcagggataaactgagtctcatttacttcatctgtacaatagagataaggatgtttctgaggattaaataaggtaatatttgtcaaacacctgctgcgttatgcaggctcaatgcatgaaagttttcttcgtctcctttctgtatatatattaacattggaaaatagacataatctttaatttttaaaatattttcataagtcattaagagaattaagtacgcagcatttgtttaaaatgttaacaacagatatctcgttcagtgaaaatttcaaatttaattctataatatataagcagatacttttctctagattcacagaataaacacaggaaatatcacacaaatctgatgactgccaagaaagggcatgattttccctaaactgcccctcacatcattgtagcatttggaaaataacctcagagagcccaggcatttgcaaacacaaaattatacaatgaagataccactacaacccccaagggtcatgtgaaactgctaaggaacataagcttacaaactaaaattatgattattgtggaaaaaaattataagcaatgttatcagatgccaaacgttaaaaggagaatgtatacctgaagaaaatagagataagaggataatcaccaaaggatattaagtaatttttaatgttcaaaaataaaaattaaatggatttttttccagtaagaataggccattatataaagtgaaaacgaagatttgaaaaaacaaagtctggaaatgaaaatataattaatccctcaaacatctgcgtgaaataagtttcaagttgaaaaaaatagggattatggggaagagacaatatttcatattaatgaaatttaataaaatggaataaatgtaaattttaatgaatcctcaaattcaataaaggtcaaccaacgtggaaaaaataaaaacaagtctaccagctagctctgaatgaaactcagagcatcagtaatcaaaaaggtatcattaagggttacttaagacaaaagaacatttacaggatgacaatattgactgaagacttttcatcaacaatagatattagaagacagttgaataatatcttcaaaatgctaggcacattttcaaataccaggtaaaacatgattcaagaattaaggcaaaatattctcagacatacagctagtttcacctgaacaaaaactaagaatttcttgtctatagatttttgctaaaataattactaagcaatatatttgtgtaaaataaaatgaaactagaaggaaggagacagcgatgtaaagctgtataaaattgttttctctgtaaataagaacatttattaaaaaagcttataatcctaaaatttggtcagtgccaccaaggaaaacacagaatactaggagaatgcagtgtttgactgatcctgtgtaaagagagagaaatcaaatagaagacttattgcatatcctatgaattacatatccttaattcatatcctgcatattacatatgctatgtaaagggagataaaaacaagacttattcgagataatggcaacaaatataaggcttgtgcataatgtgttctatgtaaattattaccaattataatgtttctagatagcaaaaaagtgctaaacctctgaaatatgtatacatacatgacctttccaagaacagcagcaaaaaaatacaaaaaaaagcccacttcagtgaagaaaaagaaatgtccattttctaaatacatttccacttgagctgagcatgttatgacatcaaataccaagtatatgatcttgatgtttaacattttatatccaacagtctcttatcttggatgcctaatgagcatctcaaacatacaatagccaagtgaaaaataaatgatccaccccccatctacgttaattggcatctaccaacatctccagatgttattaaattgcactattatttacttaagtcagaaacctagacatccttcatgattcttttctcttacattaccatgtaaattatttccactcttgttggatatacctgcaaaatgcatcaaatcactcctccgtatctgttatggaagtgctaatctacaagattattatctctcatctggattacttcaacaacctctaacctcttcttccagtctttccccacttacaccatatttctcctggtgaaggcagagagctccttctaaggagttaatgagatcatatcaggcccctcctgcccattactctttaaatgaaatcctgtgatccgctatatgatgtagccccttcctatcacttctgttactcacactttgtctccctttttgctcttctgctaacatagaggcctaaaggtttcttttctatacttaaacacaaccaatttcatttccatatcagtatctttgaacatatttttctaatggaatatttttcacctagaattttgcataggtgctataacttatttagatatcctttcatttaggaacaatgaatatttagtagaactttgatgtataatctggttatgtaatgtagtagtttctgttataaatgttttatattccctatacttatgtatgcaaattcggagtttaagactgctcgttcagaacatcagtttctcttacggttacttctagaagtaggcatactaaggaaagacacagcttctggaacataaaagtgaggtggtaaaagatgaatatgaagagggttacaatattgtattgcaatggatagcttgtcctacagcagagtaattgtaatgggatattttgacaaaattaaagtacacatttccaaaatatacatgctcttggaaggctgatagaaaattaaccttgtttgtagattaaatgctgcaataaatgtgttatttaaaatagtccttggctgggcgtggtggctcacaactgtaatcccagctctttgtgaggccgaggtgggcggatcacttgaggaggagttccagatcagcctggctaacatatataacatgtcatgtatatatatgacatgctatacatatatacacatgttatacacacacagataacatgttatacacgtatgcacatgttacatataacatatataacatgtacgtatacacacgttatatataacatgttatacacacgttatatataacgttatatatacacgttatatataacgttatatatacacgttatatataacgttatatatacacgttatatataacatgttatacacatatacacgttatatataacatacacgtatacacgttatatataacatacatatatacacgttatatgtataacatgttatatataacatgttatacacatataacgttgaatataacatgttatatatgcacgttatatataacatgttatacatatatacacgtgttatatataacatgttatacatatataacgttttatatatacatgttatgcctatatacacatgttctacgtatatacatgttatatatacatgttatgtatataacatgttatatgttatatatacatattatgtatatgttatgtatataacatgttatgtatatgttatgtatataacatgtttgttttataatgttttatatataacatacacatgttatgtatataacatgttatataacatatacacgttatatataacatgttttatatataacatacacatgttatatatataacatgtatatataaatgttataaatacatgttatatatacatgtatatacatatatacatccatatataacatatatatacaagttatatatatatgttatatatatgtattatatatgttttatatataaaattagccaggcttgctggcagttgcttgtaatccaagcttctcagaggctgaggcatgagaattgcttgaaactgggagacagaggttacagtcagcagggatcacaccactgcactacagcctgggcaacagattgagaccccgcctcaagaaaaaaaagtagtccttaattgaataaatttgtaaaataaacacctatatattgtgaatatttttccactaacttttttaagttgtttgaatctgaatagtattatacattcacaaagagttttcacatgcatctagtttgatcacagtaatgaccctctcaagtatcattttctttgtcattttactgtaagaaaaattagcataaatgaggttaagagatttgtccaaggatacatctgagaaatggaagacgccaaacttgaactcactgctttccaaaacatggtgggagttattaataaaaaaggaaaaaagtttcagtgtttaaacaattttggtaaacagtagattaagcaaactttccttactctataactttctagtgcgtttgatatgctaatgggattatgactttctatgaaggggttagattctatagactttcacatctagacagttgcagtagaaaagggaaatttgatttcagattgatgaaaggtttcttatttgagtgatggtgaaataagaatattctttagaaaaaaatgggaagaacatcaccgtatcattattcttctgttgtttgggatttccttaaatttaagcagagatgtacaagaaaagtaataacagaactgtttgccaccaccttatgtaaaataatgtctgagcctagatttaatggtctgctacacattttttatattgtctcctatcttgtaataaaagcaactcattttgagaataaaattaggggaaatatattgtctttgcataattgccacatagattttcttctttgccttgaaataacaacaaagattgtcagctgccagtgcaacatccttggagaatttgggaagataaatgattttcttatttagagacagaatgttctttagcaaatggaattgtaaatacaaaagactaataatggttgttaagggaaatgttgcaccaggatgtagctgtttgtagaatttttctcctctcagctcaattttgtaattaacatattacaaggattaaaaaagaaattagctaacattttatgtttttctagattgttgatgatcatagtggttataaatatttgtacggagtttttttgttctagtgtctagttgtgtagcataatcagtttaatggttaagtagaggcatgttcagcgagtatcagcttccagaaagatgacagactgacttaattcctcaccccctcacttcaaatgcgtggaaattctgaataaaatataatttttaaaagttttaaatacacagctgggctatggtggaacctctcttccctctgtgtgccatgaatgatcaaatcatcttacgtgaaactgaacctggattgagagcctaatggctaggaagaagttttcaagaccttttaggacaaaatatgtgaccttcaacaacacataatatagaggtgaaaataaaacccctccttaaagtctgaattttcaagggcttccctcagctgtaaaggggaataaataaatcctacccacaatggagaagaggcattatctgtagtgataatagcttaggattttcaaaacttaatagaaattccaatactccgattgggaaactgagcaaatctgaagcagaaaagattattaaaaaaaagaaatataagtatagatcatcactatgagacgatgaatctgatgaatccaaaaaaagcaaagaaataattttaaatactgctgtatttccttagaaagtagtgacacttaaaatggtacctggttttagagcaatgatagaagccagaagacggtagaataatattttcaaaaacaatgaaagaacatccacgtaggaacctagaattgtgtactgatagaaactctctttcaggaataacattgaaataaagatcttttcagacacacagaaaccgtttactagcataaaattccctttagaggacgtcaagattggtctttaagcaggagaaagatacaagatggaagatttaagctgcaaaagaaaatgatgtgcaaagaaaatggtaaaaaaatggaaaagtcttaaataaacatttaccgtgtatgaaagtgtctattaaaaaacagaaaaatgctggacatcaatgaaacatgagaaggtggttaagtttttcatccagtttacctgctacctttctatgtattgtttctcagtttccataggtagtacctacttctctaatgctgaaatgcctcagtgctcagtccttgggcacttgccatttttatttattctatatatgtcttgctgttttcatccagcctcgtgacttgattaaaacaaaattattcttttcccctcaaatgcagtggaagcaccgttctttcaaattttcagagaaaaaaaaaaatctacgcatgctttctttagcctatctctacacaatacacagggacaacatttgaaaaatataaaccatatttaaatctgatcataatccttcaatgaattcccatctatttttaagtgaaatccaaaactcttcatgaatttcaagggatatctgacctggctggcccacttcttaactcaggccttatctcttaatactttcctctgctccacctatgttgacccctttgctgctgctttcacagatctgacatgcacccattgcattgtgtgctacctctgcctaaaataatcctcccccgtttctccatgtggctcttttcgtttctgccttaacttctttactcaaaagtgtttttttcaatgaatctttctcatgtgtgcacatacaccacacacacacacacacacacacacacacactttttatccatgctttcctcatttatttttctcaataaagtgcatgaccaggaaagttctcaatattttccttctttatcttcttgagtatttatttccctacctagaagtagagctccaacccaacaatgcaaaaaaaaattgtctttttttcccactgctgtgtcctcaacacccaaaacagtgactaggtacacagtatatatttgtttaattcataaaataagtaattaatcaataatgaataaagcaattttaagattctcttagtgcttagaatgaaaacttgcaaaatttcttgtgcgtgttaagaattttatactaatcattaaatcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaacacagagttttgttgatgattttctttgatgatgggggtagtgatcgtggtattgttttattacattggtttcttcctttttttgttcatttttaatgggaacctcccaataatggtgaggatgcagttaaatggtaactccatacacttagtgtgagtctagaaataaattcaagttttattttgaatacactgaattggtatttctttcattgaataaacatttatctagtgcctcctaagtgccagacaacacaaaacgtaaaataccattggcaaatccatagcaatcatacaaaagacgtgatatttgataaatataactcatacaatgaagaaaaaaaagaacaagaatttatacacagcaatttgacctccgtttgcaacacaacaatataaagtgtaattttctccaatctaaatttgctttgaaaatatggaacaccagctggaagggagctcagatggcttctgcagtggggttggaaatatccttctgagcatgtccagaacaactggttaaaaataattaaatcacttgcaccatctgtgaatcattctgattcttcaatgattacttaagactctcattgtatggaacatattctgagaacagatgaataaaatctattcaagtgtatattgttttccactttgattttcacaaaataaaaggattataatattttcaagttggtaagttatctgataattctcctgccctcctttatgatccagttgcttttgaaataattaaggtttgtttaaaatttagttttatgaataatacaaattcacatagccttgatgttataacataattttgcttaaaaacattctatcatttttaccctttatttaatcttttgagtatagtttagcacccatttagtaacagccaagagaactaaatggaagtccgaattgattgcattctcaaatttagcaccatatgctataatcatgagcagtttttaaaattcctaaatagctattttaacgcatgtaaaacagaggaaagctatatttagtggtgactaatccatggatgaaagatgcatggattaaatataatccaagtgcccatatctgtacaaacttaagatgttcagataatttggaggcattgttaactgtttttctggatatcagtgcatgggcacttctcgccagaataaattaactggggaaagttccagaaggtccataattttccataataattagtgctttcttagttaatagactatctgggtgatgaaaaataaatgaattacctaacaaatacagttatctataacatataactccatctgtgacccgtataaagctcaaaatgtgttaactggttagtatctagacaatcataaacacacatgaaacatgaataatatcggtcactatattttcatttcttgcttcgtagatacactcgagtatttcatatgtggaaaattaagagatctagtcctcttcatatattggcctccctaatgggaaagggtctctttaatctgctacaaagccctcctcttctttaaacttgccaagatgtcttctacctcaggtcattgcaattatgtttcctttgacttgggcctctatttctggatatttccttgctggtctcccgtcacattgcaggatgcagagtgaacattatctccacaggtggcctgccttcgacaacctattttatgtcgttcgccacatccattctatccttaccatcatgctctagaacatcagctagacgtttcccttctaatatttactgcaatctgcaaatgttacctttgcatgtttacttgtttataatttgtctgctatcattagaatgtaggcttgatgaagtcaggagcctattctatcttgttagtcactgtttccccaagacatagagtctatcacagagcaggtatttaatgaaagtatgtggaatgaatgattgaatgaatgaatgtataacatcttcctgtggaaatccctgcagtttcagagttggttgttctgtatttttatgtcagtggtatcctaatgccagtctgccatggtccagaagttttcaatggtccataaggaaaagaaaaaaaagagcaattttttatttagcttttcataaagcaaagttttttaatgcaagaattgtcctttctttcaaaattatgggtttcaacagttttggaggtattaaaatggcctttctttttctttcttctcattttgttacaatgtcctttactagaaaaagtaaagggcagaacttttgtgatgttccctaatagttttttttttttgtaatgttgttattgacctatgaaatacaatgtccgtaaaccaccaacttagataaatttatttacatgaaggaataccattcctgctaagtttctatattggttgcttgaagtttcagaatgaggaagagaaagcatgaaaaccatcacctcctatatgtatggcctgttcggcaagcagtactggccccataacagttatccactggaataacattcttgaatttattttgtcacatgtgaggagcaaaaacaagacaaaatacacaaaaaagagtagaattagggtatcacgacatttgtctaacattgttcaacgttaacacttacaaataataaaggtaccaaaatggtattttcttgtgtataaatattttcatcctctggatttgaatctgtttttgtttgttttggtgatataaagaactcataatagtatcatttcctgatgatatttggaatccaaaaattaattcaaaacagaagtattacattttctgtccttttcataattgtaaacaatgcatcaagatcaaaaacttaacaaaatgcgttaatgttattatgcatgcttttttcacattctttatttcccagtgatcataatgactaataattaacataattatttgtgattgacaaaagactctaacgttcatcattttagttaattattatttaagaaataattggtctggatataatataagccaattaaatttgtattctgaaaagttttgagaagtgaaaaaaaatttattttttatttggtaaaatactttatttctgttgtagctgcttttacaaggagattgtggggaggaacagtcatatccaagttctcagttaattaccttttcaaaatatatgatctaaaatggagtgaaaattgattgtgtcaatatgagtttttagagttaaaacttgtaaattttctggacagaatagaacaattttatattggaatccttgccataggataatacaatgactattatttcctggaacattgacagagaacaagctattttaggagaaactatctggattgtaaagtagagcacattaagcctaaggtgtcattaaattcacaaaacttttaaaaaagaattgagcgtaatctttggtaagagaaaaatggttttcttcagtgactattaccatattttgcaaagttataacctggcaaaatatattattttgggaaaataatattaaatataaccatttctatacacacagtggcactttatttattcagaggtcagatggatatcattttaatttacctgcaacacagccaagagtcaggaatggagtagaacaaaaggcctctcgattcccaaaattgattttttaaggttcatgaaatccaaagcttacttatatttcattatgaaatgaatttccaaatccttttttggagattttttaaaaattttgctttgattaaagaggtaattctaataaacttaattatctctttttttttttgtgcccctagtagctttgaagtcaaaatgggacagaaggaataaatgactgaaacaggagataatagctgcagcctcgagtaaggtgaaaaagaacctatatatatggactcatagtttggggaaataatttagcacagggcaacacagatgagagagggagggatggaggaagggagacagagagagagaacagataattagtgtttatttcattttatacttatggataatttaattatttcaatagtttattcatatagttaggtaaatactttttttttttttttgagacagattctcaccctgtcacccaggctggagtgcagtggcatgatctcggctcactgcaccctctgtctcccaggttcaagtgattctcctgcctcaacctccagagttgctgggattacaggcaaccgccatcacgcctggctaatttttttatttttttagtacagacagggtttcaccatgttgtccaggcttgtcttgaactcctgacctcaaatgatctgcctgcctcggcctcccaaagtgctgggattactggtgtgagccatggcgcccagcccaaggatctttaatatcttacctatgtgcaaaagtgtttaatacataatgccatatggcatattagcttcctaaatcacataccactgccaccagctaacttatatctctatatttacatctgaggctgcataggcacacataaatgtattcatatatgttacacatatgcttatttatgtagctatgctatatgttatttgctatttacatctattaagttacttagcaaaatatgtcctttggctttgaaaaaaatgcctgctgaactcatcaagattatgatttttgtaggttattctccatcttttagtcgagttcctaaagttgtgtttttttaactgcctgctttttattgcaggtatatgaaattgttgtgcatatttcaaagaagaatagaatgcagggtaactctcaaacttgttatttggaattaggtcagataattttgtaaatactgttatcagtatatcacaatgtcattagtgtcccttcaagttaagggcatggaaataaagatggtctaatgtgccaggccaaagaggaaaacttttcagcttagcaaagtgacttcaaatacatggggagaattgaagcagtcatttcaaatgcaaacaaaaagttgtatttttatggattacaatatccttagctaaatgtttactttggcttgggtatttttctcattagtgatacttatttaattagttgcttataaattgaacctgggaagtgtagtttgcagtgagccgagatcaagccactgcactccagcctgggcaacagagcgagactccgtctcaaaaaaaaaaaaaaaaaaaattgagtacttaagatcaattaaaatatatcgagtattggatgctgtcacataagagtgctattagccattggctgttaaatttcctcatctccaggaatctcaggcacctaaaaataattctctttacttcatgggcaacagcagccactagtctttgccacgactcttctgtcaattgggtatgcagtgaggggcaccaatatggttttaggtgatgatgtgaaattgtttcaaaatgctttcattctcccttctgaattttgtcttagtctatgcttccataatattgggagccaattagtagtacatgccttcctgcagcttgaatagaagtgaagtctattatgaacaataaagtcaattagagggggccatgcctactgataaatatgttatgtaaagactcaatttaccttgaaatctgtatctatttgcatctactctttagtgctagttcagagctctgtgcgattattttaaatgtattgcagtattactttaatcaattaatacaaaggtagattaaggaaactttactactcttcatttcttcattctgctgattcctccctcactgaagcaaaaaaaaagtctacaatttagtctttaaaaagtctatagtttagtcttagatatctctttgtactatattccatatactgttcattcttaccaatgaatagtatatatagatatattttacttttttaaaaaatactgctttattctgtgtattattttaaatataacagtcaattagaaacatgttcccaggtaatgtatatagatcttatacattctttgtgaaagtcttagatgatgaatcaaaatgtattctattattcttctacatttctggattattatattttgattagaaaaggtggcctatcaaatctttctttttgatgcttttaaaagtttcctctctatgtaatttttgatgtcccaagtaaataggagaatatgctttttccagtgtgcacaaaatacggattaaatttagcttgtcggttttaaaccacctctattcttgttttttatttgtattttttgtctattttaatctaacaaattacagaagagttgtatgtaaggtaccaactacagctatgattttatcatgttctccttttatttctagtaatttttaccttatgtagaatgcacccaattgtttggggcatagcaattaatgactactgtgctttgggaagaagtgtgatttttgtcattacaatggttctctgagacccatttagtgcttttcggtcttgaactatacttcatttgatgctattattttgactttcactttttaaaaaatggttttctaaatcaccattaacgcagcattgtgaccttgtatttttatgtttcttgtgactttcactttttaaaaaatggttttctaaatcaccattaacgcagcattgtgaccttgtatttttatgtttcttgtaaacagcctatagatggagtgtgcattttaaactagataattttgtctttttaacttatgcaaatatttttacatctttatagggtacatgtaatattttgctacatgcatagaatgtataatgattaagtcaggatagttagggtatccatcatctcaagtatttatcatttatatgtgttggaaatagttcaactcctctcttctaggtattttgagagatacaatatattgttgattatagtcaccctactcttctttcaaacattagcacttactctttctatgcaactgtatgtccgtacccagtaaccaatctctcttcacccattccgcccacctacactcttcccagcctctggtatctataaaaaaaaatcacatattcttaccaatacgtgcttgatcttatgaagatataaaaatgatagatagttcatctttagatgagacattttaaccaacttcatttttacaataactcttataactgtgtctgttttaattccttgtcatattgatggtcattattttatcattttatttactcttatcccttgtctataattttataattcatcatcttcttcactgcactctactgcatctcttcccgcacttataggttatttataagttatactttgtactatcattttactagtgctgtttcccattttaaacaacaattttatgcctatatttctgtagtgttgcgccaaaattaaataagaacaatgccctcatcaccaagatgatttacttagtcaactcctcattattttcaatcaaaggcaaaatcctttaaaaagaaataatttataattttatttcctggctactattgttttcacttgtagtatcacatactagttcaagatgtcatgttattacttaaattacactatcacttcataaaatttgaccacaaacgacacaaggtgtatttcctgtcactgtttttttgtaccgtttatttctcattgttttgaaatctttattacacagtcatccttcagtgtctgtggggcactggtttcagcattttgatatcaaaattcaagaatactcaaattatttatataaaatggcatagtgtttgcatgtaactatggacaccctcctgaacacttcatatcatctctagattatttatagtacccaatacaatgtaaatgctatgtaaatagttgttatgcagtattgtttagggaataatggcaataaaaatgtctgtacatgttcagtgcagacacagccatccatgtatttttgcaaatgtgttcgatcgatgactggttaaatccacaaatgtggaacccatggatacagagggccaactgtacttcagttttaatttggttggaacacatgagaaatgtcctcgtaaaaacataaaggatgtaaactttgtaaaccttgcattttcgaaatgatctttgctttgcagtcatcatgatggatttattggatagtaacattctttaatatctctcctctttttttagtagtctctgtaggttatgaacaattgtcttccagtttccattgttttcttgtttcaactatcttcaagctactattgtttccagtgtaaagtctgattctagtccaagtatcatttatttgtatttaaccttttttctttctctcaaactctaaagttgctgtctgtcccatctattgaagtacagaaatttcattaagatataattttaaatgtttctaaatgtgtccctgtttattattttattttattttattttgtttttatttttgagacagggtcttgctattgcccaagctggagtgccgcgatgcaatcatagctcactgcagccaccaactcctaggctcaggagatcctattgcctcagcctctttagtggctgggactacaggccatcagtaccatgactggctaatttttaaaacatttgtttgtagagatgatgtgtcattatgttgcccaggctggtcttgaactcctggaatcaagtaatcttctcacctcagcctcctaaagtgctgggatttcagttgtgacccaccacttatttaattcttttttgcacttgggtaacgttttaaataaccaattaatattaataacttctttagctctggaaaattttctattatgattgttttaattattacaaatcttccatctcttcttttttctcattctggtacttatcattgcttaataggtatcttagatctgttctctaagtctcttattttttcactattaatgtcagtttatttctatttgtctttaaattgtgatatacttcttctggttgactgtaaagaacccatattttatttttagccatgatcattctcttttctaagttgtctattgttatttaaaaactaggtaacaggctttctgtgctctaatgttaaccttttaatgtttctaattttatttttattaaatgtaccttccgtatcttctagtatactacttgtatggactctcagctttgtctttctctccagccccttgtgtcttctgaaaaagcctttgctttattttctctcatgcctaagtcaaagaatgtaaaatgtcttggcgcaaatgcagttaaggttttgatattttgatgcatagtgattgattgagaagcaacatggatactggaagttttgttgttgttgttgttgttttgatctgatgaataattatttaacaagctgaaacctattcacaaaatttacatatgggaaaacatctctgatctcatggacaaggggtggaagtaaggctgtcctcaaccatgtagtacagccactctccagtaatgcctgcatgaaacaaactagcaggtactgacccccttcttaagtcaaacagatctccttaaatcaatggtctccaacagatcattccacatatatacttgaaaaccatcagatccatcatttctgtctcagatcgtgccaagatacacataactttgaaatatcaccagttcatcatcattctctcttcacctgcaatttttttttccataatttgaggtcctgatacatatattcttctaaattgtagcagttagttgtgattatcttgacgttgcatggactcagttcaaagtgaaacagaaaacatatctacgatgtgatttacccattctcaacatttctattttgtgtgtctgtatttgcacagacacgtacatacatacatgtgcatatatataattaataagctttgaccatataaataatgcaaattatgtataattcacaataataggtttttaaattaattatcttcagagttgagtgagattacttacagatttaggctgtgtctacctgaaaacaaaatacagtgtattagcaattcagtaaaatcaattggatatagaataataacaaattagttgagttttcaccttgtgacattttagtttggatttagtagcctgtctaaattacctttgtgaaaaaactaggctacaagtattttctgatagatataataccagcattagaattattcatataatcttagttttcacattatttaaaatagaacacattgttatattttaataagcaatttgaaaaagaaacaaatctttctttcttgtatgattgccattataaaagaatattaattgagtgctcattaggtaactttaaccacattaagtactagacagccctttggacagagactgagtagaataaaaaacgattacagaacatactttggtattaaccttttctataaataaaatgtattgtcattctctagattagcactgtcctatagaactttctgagatgatggcaatgttctatatctacactgtccaataaagtagctattgaggctactgagaacttaaaacatggctagtaaaaacagatgtactaagtttttaattgtatttgcttttaaataatttagatttacatttctttcgtcaagtgtagctaatgactaccatacgggatagtgtaattatatgcatctttactatcactcgcatttctaatgaagagaatacttccttgaaaaacataattatgacacatgcatatttagacatagatactgagttgccgcattaatctagagatagtgtccacattttctgaggggtgtgacaaatgtaatatagaaataaaagtgtgagtttattctgaaaaatctactcaagttgacagatccacaaggcaacagaagttaaaagcgatataggagggtgaaatataactgcagtatttaaggtctttccatacttattttttcttgtgttacttttattttcacactgaattaagtataagtatgtgtgtgaggtggagggagggttcgatttgcttgtcaacatacaaaaagattgctatagcaagtattcccaagctgaaattttggaatagcttaaaataaaaaatatatactagatatgtaaacgaaaacttttatgagaagagtttgggaagagttatcaaaggttaaaatgattttttgaatacaagtcttctcatacccttcaatttgctaatagacattatgatacccatgaagaagctaaaatcagtatatcttaatatcgtctatatgtcattacctcaaataattgcttatgtttgtattcaagtataatgagtcagattagtaactaaaagacaatttaaggacctaagcacgcatgtacaatagcatgtagctaatgtgctatgaattgaagaaatgcgacatagtgaaatcagatataccttttaaatctatgacaataaagattgcattataaaatgaagaaaatattcctgtttgaattctgaatattcctaaatataaattataaatgtaaatcccagcaattgtaaccacatatctatcttataattatcctgttaagttgatacttgttttttcattaatttatccaacaaatatttttgataacatactgtatgctaggtactaggcatgagtctttgctgcatttattttttgctgccttataagttggctagggtgtataaccttatctattaatttataggttattttttggagatggttttacaaagcaggccatgattgttggtgcttatatattgctgcttatgtgttgatacttatcttggtggcaaccaaagcccttttctttctcttctctcacaggccatacttagtgactaaaattttatcaagttactaatttatgttaattctttgaaaatctgtataaaaatgcaaatgttgtcctttgaaacgaaagactttaaaccactataagccattaacacattttccagattcagtttatcagcttaatttgatagtaattgagcttggccctgaggaattaggtaaatttcatggtgtagaaagtcagaatccacatgaggcaggtcaatgagcaggtctgtccagaccttttacataggacactatttatacctggccttctagaagcagggtgtatttaaagactggcaaatccagcatcatctgcatatctttttcgctgacagcctgccctgctttaaaaattaattctaactttagaaaataaataatatgggcataaaggatgattttctttcatattttaccttgactattttgtgtatgttagtgagttttattctttttaaacaaagggggtaaattgttcattgattctgaataattattctgagatggacaggccctttttttggttacatagcttcacataagcaattttttagatgatgcaataggaagggggaaatcacataagagcaaacactctctcattgctattttttctatgcacggtcataaccaatatgcttagactcattagattgattattcaacatctttctacccagtgacttgactaaaacagacaaaacgaagtactgtcagaatgctgttattgtcatgccattatatgtatccaaaacagtgacaacgcagattaaaaccatacccgtctcacctgcatcatgttgttttgtttttatgctttattgtttggggttttttaatcaccctggaccaatacaatatttttgcctaatttgtttgtgatttgcatttttatgcttacaatgcctattataattgtccaggagaaataaataaaaaatctctcaactttgtttattactgtaatgattcctagaaggaaacttgtctttctctgaagacttgtggggctaagagacagagctacttgtctaagacttaagtctttcccattgccttttcatttatgacccatcagaacctacttaaagcctgcagtcctattttggatttacatatcattgtgttattacttttaaataatccataatatttaagaatgtccctttgaggaaagataatcagatacaaactgacatactttcatattatggctcatagattttcatattatagctcacactaaatcattaataaatcttactttgaggatttgcttattttcatcttcattaacaccaacgcagttaaaaaaaaaaaggctccatcactattttactgtttttggtcaagataatagtctatttttgttacacttttgatgcattgatatatttttcatgtgccatatttatatgagatatatagttattttgtggcatatgtcataatcatatgtcatatagcacatttttcttcttgagtttctttgacctcataactcataaatgggccagtaacctcaatgcatttaaaggagaaagaagtcttttaaatcatggaggaaaacattttgtttaaaaacctagacataatgcaccatttgtttcaaaacaggattgcttttatcctttgcagttatggcccttcaagaaacaaattttatgtaatgaaaagaatgtgataacttaagtttcagatgaatgaaaatgtattcaaaactttgtgagtgatacctgtgcctatttacacagctcagaatcttaaaactgttttgactttaagtttagatcatacaaatcataattgtgttctataatagtcattaagcattgatcgaacttttcatttttaaataaaaataggcattttatggtttctttcacatatctttttgtttctagaaaatgaggctagtatattctttggggtatatatggttaaaaatgaaaataaacacaaagaaataaaatgaattaatcagattatagcatttccttgctaatgatgcatgagtatctataatgatataaggtggtaaagaacattaacaaaagcaagttgattttcaaaaggttagacgggatttgtacacatcagaactcagaaggataaaattattcaaggcagagttaatgaaattcaaatgaaaaggattaatctgaatgagtacctggattttgcataaagaagagaaaatgaacatgatatttctaattacactgatttttaaataactgtctgaaatttttattaaaccaaactgaaagtcattcaatggatgtagttttctcattatagattcgcatgactgtgtcaataggaatgctatacttttaaggaatagatagcaaactagatctccaaatgtctggttctcttttgattcaatttctggtagtttcttgtatatgaaaattacaaaaaagtctatatattaaacattattgtatatatcagattgctataataaatgagaatattcaaacttaataacacggaattttctagaaaatgagttcacagtttcccagtggtgtcaaaaagttattttggaatatttctatttctcaagaaagttcacaggatcaacccttagttttctctagtcagctgatctgtaccacttagtgtctgttatctgtgatgactggacactacgtatcaagatagtaaatctttcaatagatccgtcttcattaaatatatttaaagtataacattaaccttttagactttataacgtatagctgaactgttgcccataggtaattgtaatgagaagcatcttagaaattacaggtattctaatttatctttataatggaaagaaaaatttttgaaagattacttaattatcagtagttgaggatagaaatgatttttctcattcagatttttctaaagtaataaactatacctttttattgattatgttcaaccataagaattttaatatttctaagtgttctagaaaatgtgttcatgccatggctgagcatgtagggattatttccatgtattgacactggttgctctatggcttatttgtgacaatcttgaaaataatcacaatatgcatattattagagcattctcaacctgcagttcaatggctaatatttcttttaagagtatttcgatcaggttaataagagcttcttcattatttaaaagtttgtaaaaaatgatttctagaaccagatacagaattacaattatttgtcacttaggtatctaaaattttcttaaaaattgaactcttgtacagagagtaaaaggatgattaccagaaaaattggcaatttaaatagatgccacataacactcttctaaaagagattttctttgaaagataggtgaaaatggtttttagtttaatgttctgaagaatatttgttaaatcggtatataataatctatggtagacacatggggtcaggtggagagaagcttaacagatgagaagccagggtatggtgtgctgcctacattctttaagccctggtttaggactatgattaacactggatcttatttgctgagacacagaattctggtctgagagcacgaattattattttctaagtgaatctaatttttattttatccagtgtcactgaatgattttttctttttttttttaattatacttaagttctgggatacatgtacagaacgtgcaggtttgttgcataggtatacatgttccgtggtggtttgctgcacccatcaacctgtcatctacattaggtatttctcctaatgctatccctccccttgccccccacccgccaacaggcccctgcggccatatgttttcattgttcaactcccattatcagtgagaacatgcagtgtttggttttctgttcctgtgttagtttgctgagaatgacggtttctagtttcatccatgttcctgcaaaggacacgaactcattcttttttatggctgcatagtgtcccatggtgtatatgtgtcaattttctttatccagtctatcactggtgggcatttgggttggttgcaattctttgctattgtgaacagtgctgcaataaacatacgtgtgcatgtgtctttatagtaggatgatttataatcctttgggtatatatccagtaatgggattgctgggtcaaatggtatttctggttctagatccttgaggaatctgcacactgtcttccacaatggtggaactaatttacactcccaccaacagtgtaaaagagttcctatttctccacatcttctccagcatcagttgtttcctgactttttaatgatcgccattctaactggtgtgagatgctatctcgttgtggttttgacttgcatttctctaatgaccagtgatgatgaggtttttttcttatgtttgttggccgcgtaaatgtcttcttttgcgaagtgtctgttcatatcctttgcccactttctgatggggtcttttttttcttgtaaatttgtttaagttccttatagattctggataatagccctttgtcagatggatagattgcaaaagttttctctcattctgtaggttgcctgttgactctcatgatagggtcttttgctgtgctcttcagtttaattagatcccatttgtcaattttggcttttgttgctgttgcttttggtgttttagtcatgaagtctttgcccatgcctgtatcctgaatggtattgcctaggttttcttctagagtttttatggtttcaggtcttaggtttaagtctttaatccatcatgagttaatttttgtataaggtgtaagaaaggggtctagtttccgttttctgcatatggccagccagttttcccgacaccatttattaaatagggaatcttttccacattgcttgtttttgtcaggtttgtcaaagatcagatggttgtagatgtgtggtgatatttctgaggcctctgttctgttccgttggtctatatatctgttttgctatcagtataatctgttttggttactgtagcattatagtatagtttgaagtcaggtagcgtgatgcctccagctttgttattcttgcttaggattttcttggctatatgggcccttttttggttccatatgaaatgtaaagtagtttgttctaattctgtgaagaaagtcaatggtagcttgatgggagtagcattgaatctataaattactttgggcgctatggccattttcatgttattgattcttcctttccataagcatggaatgtttttccatttgtttgggtcctctcttatttccttgagcagtggtttgtagttctccttgaagaggcccttcacatcccttgcaagttgtattcctaggtattttattctctttgtagcaatttttaatgggagttctctcattatttggctctctgtctgttattggtttataggaatgcttgtgatttttgcacgttgattttgtatcctgagactttgctgaagttgcttatcagcttaaagagtttttgggctgagacgatggggttttctaaatatacaatcatgtcatctgcaaacagagataatttgacttcctctcttcctatttgaatatctttctttctttctcttgcctgattgccctggccaggacttccaatactatgttgaataggagtggtgagagagggcatccttgtcttgtgccagttttcaaagggaatgcttctagcttttgcccattcagtatgatactggctgtgggtttgtcataaatagctcttaatattttgagatttgtcccatcaataactagtttattgagtgtttttaacatgaaagggtgttgaatttatccaagaccttttctgcatctattgagataatcatgtggtttttttggtcattggttctgtttatgtgatgggttacatttattgatttgcgtatgttgaaccagctttgcatcccagggatgaagcctacttgattgtgatggatatgctttttaatgtgctactggatttggtttgccagtattttattgaggattttcttttttgttgtgtctttgccaggttttggtatcaggatgctgctggcctcataaaaagagttagggaagaatttattttcttttgtattgcttggaatagttttagagggaatggtaccagctcctctttgtatctctggtagaattcagctgtgaatccgtctggtcctgggcttttttttttttttttttttttggttcgtaggctattactgcctcaatttcagaacttgttattggtctattcagggattcaacttcttcctggtttagtcttgggagggtgtatgtgtccaggaatttatccattttttctagattttctagtttatttgcgtagaggtgttgatagtattctctgatggtagtttgtatttctgtgggatcggtggtgatatcccctttatcattttttattgtgcctctttgattcttttctcttttcttctttattagtctggctagtggtctatctattttgttaatcttttcaaaagaccagctcctggattcattggcaaatctcatttttatttaacgttcctttctgcaaataccaaaatagtcaaaatttgggtttgaaatttcatttaaggaagttaaatacaagttagcagacaaaagtgagtatattttgagtgtctttttcttcattatatttgaccatacagctaagtttcttgctggctataatccacaattactatatttattaagcaccaatatgaatttaagatagctgagagcatctcaaatgaaagtaatgaagactgagaaaactacatatcaaagaagaatcagaaaatagataaaaacatcttagaattatttttcttttaagaaaaagtgatgaggacatgcatcaaaacttttctgaattcccactgcttttgttaaggccacccagatttttttctaaatattttcaagatatgtccaattctgaaacaactcccttgattaaacaacaaaacaaattaataaataaatgaaaaactacaacttgtcttctacttactctgttcctgataacaaaaacctttgttttccaaaaacttacaggtgtaaaatgtatcattaaaggcagatttaattgcaccattaaataagtattataagaaatacgcttgctttagatgatgtgaagctatctttactgcaggggttatagcaactaacgtgaataagaaagacgagcttattaacttgtaaattttattaagaacaacataatggtcaccaaccaatgtaatgcgtgcaaaacacaagcttgtgttacttgtgctattgattctactgtttaatgtgtcagtgaaaatttcacattcaaatagcctgctgagttatttttcttttaaatgtgtaaaatgcttatgatgaaatagtgaaattaagaatttcttaagaaatctgttaaattctgaattttatttatcaaactctggctcaagtttctaatatccttttaaatgtaaatgagaaatatatatacattattccattgaacatgaaggaatgtgtgccatggatttggcccagatatacacaataaaacaaatgttgtaaaaggtataattatttaatagctaatttgtgcaattctgtgaatttgctatatcacaagtagatgagatatctaaattagaattacttcattttttatatcatgtaagaattgagtatgaaaatcctaggtcagagaaattaaaaacaaaacataaagtgaccagcttgtaaattttactcctctttgtgtggggttcagtctagtatccccaaagtccaatgtattacattactgcaaaaataagtatggtgttgtcataaaaggctgtgcagtaataaatggctacgttagcatgcttatcgtttgtacttccccagagaccctaccactgaaaccctcaggtgacctcatcaacaggcaggtggcagttgatcaattctagacaaagttattgggagaataatttcaattacaagaattttgctgcctatagtgtagacagaagagagcacaggtcatccatctttctgaatttgcctgccaagtagtatttattttttgctcttataaagaatagggaaagatgtattactgggaaactccaaaaggactctggagctggaaattctcatcatgtctagcacttggatcccagtcagaaaagtgtaggtgcaagagaagaggctagtgctcccttatatatcaggacattctggagttctttttaaaatataaattccgcagtcagttctgctcatatagcagcttcattagcagcttaacttagcaagagactagcaacaaaaacaggagctaatgtctagaatttggaggagaagagggcttaatacaaagttacataccagcctaactacttcgtatctgttgtatctcagtgaactttcctatagatacaggaaagttgcctgtgttaggaataaaacagatatgagtccccctcacccaatcccatatctagatttccaggaaaattagaattttaaatgccagttgcaaattagaattagaaatttaaatgccggttgcaaaaatcgtctttttcttaggataaaactactctccttatgacctcatggtctttcgtcttatatttatggtgctaatatgtgtgtgtcacttattatgaaatgcttttaacactttctggaaaaagtaggtatataattaataaatcaccgttttactagacttaccatcgtgaggttttgaatccattttcagcccagtttgtagattcaattgtcagctgtagaatgagacctatataaacttaatggaggaggtttcactgttaggaagctaaaaaaaattgttcttttgtatatctataccagcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaaggtaaaaccaaagcactttcattcgtattttacaaggtgatcatactgatcattcatagtgccagaacaattgacttaaattgtatgcatcatgatggcattttgactttcacatggaattcttaaaaatacttgatagtgtggttggcttcagaaatctagggtagaaagacataagttagaaaatgtattttacaatatttagctttgagagacatcctaaaatgaagaaatgcacaaaaatgatcatttttacatgcagtagggacagaaaggaaccaccagtaaataaactttgatggaagaacagtttattcctagttaatggatgacttctgtttcattttccaaaaagggaaattagatttttcatttatatgtaatgtatattgtttttgttttatattttttatgtatacatattcaatttcaaattaatgtcaatacctgtgctataacatatggaataaaattgaatagaaatcaataaaatattttctttataactgccagttaaaggctaccaacaaaatccagctgttttcaaaccaccaacagcaagttactaaattctcaagtaaggcaaataatgatgatgaaataggctatgaatttcagaaggcagtgtctgaagataaatgaatgtaggatcaagaaaatgcacataataatgtgtctccagataattttcatgatcgtacattttacactcaaaatgaaatattatagtatacccagagcttggtattttcaaatgcaaacagtatgtgattataggcaaaagatgggtttgctatcagcagcacatattagctaaagtattttatactcaaatggtttcctggaagctcattctatatcacacatttgcctgtatgaatatacaaatggataaagctatttgtttgttttggaaatcggtgttgcagtatcttcagtgacttgactttaatatcttaacattatatcaaataagctataaaattacacagtaaaataagagcttcacagatctctggaactattccatccatgtcagtgtggcactgtttcttattctgtttgaagtaaaagtcaaatcacttattggtacaatgaagaaaagaaacctaatcagttaataaaataaagctgacatgccagaattcctgtcattatttctattaactaagttctcatggcagcatagtttgtaagtgcatcattgtcattcaataagtaaattattgccaatgagctaatatccattccttcccaggttcatggacatttggttcaggagagtagtgaccctgatcttattaagttgcccattgaataactctgtctccatacctcttagcctggcatactcagaatgttagacccttggctacactcacagtgaatcatttgttcatcctgatctatttaatattattatagctgatgtcaatcgtaatagtattgattactgcggtttataatatggtattattgtagatttaatttagctaaatggttgaatccccataagatacagttgtgggcatgattccttctgtctcccaacaaatctccagcaggtgaatgggcttcctaccttcattgacttttttgaagggggatagttttgagctcagtcttttcagtgaatatgtatttcctgttaaaggcattcatcattgtcattatccagtagtaaaaatggaaaagcagtgcataaattgtacagctgctggttgggaaggtttgaaattgtggttgattttattcctgacagatatgcatgaatcaaattacagaactatagtaagtattgctgtgctttaacatacatcttttttgaaagtgcagtacaacacaaataatatgtaatatgttaaaagaattactttctaaacaaaatacaactaaaatagcacgtatggtttcaatagatgtattgaattggaaagctacctaatcatgttgacagagactatgcagataaacacaaacatatatatatacgtatatatatatacatatgtggaaatctgcatttaatagcaaaaacactagctaaggcagagctagagaagaatgagaaacatacacataagtaatattttctttcttacttcagagccaatattaacagttaattgattgtgattgcttatatgtacaaagttaataatactcataacagacaagagtacataattttagaagaattgcaattttttggaagtttagagcaatattaacttgcatttcatttttaagaaaaaatcattttcatgataaaattttccaaaatataattactgtgttaaaccgtcaaatcctgccttaaagtatctcatatgaaagcatgaacacagaatttcttagcatcgtaagttttaaattaccaaaaggttttctctggagagagttaaatatttgaaagcttatcctaaaagcagaaatgatccacttaaaagacttaactgaaaggatttatcatcatgtgtccatatgcctaattttactgaaagcatcagttttattggaggatgaaacactcttgggatgtcacccatatcatttcctgactcagcatgccttgtactctgactggtagctgccagatccaagtgtctctgactgtttgccttagggctctctctagtaatcaaagctcatgagtgtcaggtagttaaagttctgcatcccccgtgttccccagcaaacctcaaccaataacaaataacttttggtggataaataccactactcactcattcttcagttagggtaactctgaagcatgatttatgctctgacccaaaattctgttccaggattaagaccccatcgcacacagtaaaaacctgcctcataggatacatttcacttgctccctgtcctaccttacacacactttactagcacctccttggatcattcccaaagacatcccttgtcttcgaatctgcttataggggaactctatctaggacatttttgaaataaataatgacatatttactgtgtagttagcatttacgtagagaaattcttagaaatagttcatgcctttggagtggaattcttcaagtgattctgctgctccctcattcagggaatccttagctgttcaattaggccttggtatcaataaatgtgaatttttaggacaaaaataagaacatagcttataataagaatgacaactatgctttaccttttgcaataatgagaatcaatttacagctaatattattctttatggtagagcagaatgtcttcacctgaagaacatgaacaagacaaggatatctgcccacatcccttcaatattccacattgcactggagtttcaaatcactgaaaggaggaggaaggaagggaggaagtaaggaagaaagagagtgagggaaggagggagggagaattgaagaaaagaaataaaataaggagagaaacaaggaggaaataaatggaaggaaagaaaaaatatcaggcacacatcatttcagttgtctcatcaaaaccaattatagtacagatgccttgtttggaatgaataaaatgtgctatactttgggtaaccaagagggtgatgaaaaacgtggccatatgaagaaagctcacgggtaggagacatggtggtcctaatgtagattttaaataggatcaagaaatagagacaacccttgttcaagttcgagaccacaagggaaagctggtagtgagcttataagccaaagatagtgtgaagccaggtcgttcaagtcctcttgagttcaggttttttgcattgctcttgagaaacaaaaaattgttaggacaagtaaacctaaggaatgtggattcgtatattccaaaaatagttattaagctcttagtatgtaccacacactattctaagtgcttataaaacagtgaaaaagactaacgaatctttgccctcattcagcttttattataacattgggagacagaatagaagcaagcaaacaaagaaaaatgataagtaaatattgcgtattactaggtgatacgtattttgggaaaaaaaaaaaaaccagaatctgttaaggggatataggaccactacaggggtagacgtaggtataattgaaagtggcggaattgccatttcaaatagggtagaaatgacctttgagcaaagattggaagaaggtaagggagtcagccatggagtctgtgtagaggaaatagagtagaggcccaaatgtgggactgagcttatcttaatcaagcaccaacaagaaggccaaagtggctgaagcaaaacaagccagtggaagggtagaaagagatgaggatatgggagttgtgagtgtccagattgtggagggcctttggggccattgtaaagaagattctaaatgagatgagagcaattgtaagtttctgagcagttgagtggcatgatctcaatcatgttttaaaaggatcacactggcttctgggttgagagtagaactgtaggggaccaataatagaatcaacaagagttgaaaaagagatgctggtggcttggacttggtcggtagtgagagaatgtcagattctggaaatattttgaaattagagatagcagatatatttctctggtcatacagaaacttaagcatgtgtctatgaaaacccattctcggccgacttggggctgagttagaactttggtctcgtaaaacctagcagaagatcccttgagagatgtatgatttcttctcatattttagtcttcgattcttcagtcttgccttgaagtagggacaaaagtactggcaacagagatttttaatacactggttaagatctttctcctctggaatctgtttcacagctcttaagcacaaatttaataatcccaattagttaaatgaaggcaaaattatgccatgagcaaagtgactgcttttctattctggtattaggagaattagataatagcaagaggcaccatatgtagaaatccaaacaaaatatctgaaggaaaataaaagaacgattgtttatatgcgtattgtaatacaggggcatattacattgtttatatgcatattgtaatacaggggtatttaataatattggaataagaggacattgcaattactctaaataatcatggatcatataaaatttcaaagcaaaatttgtttgcaaatgctttttgaattcgagttgaattttctaatagtttaatagttctaacagtttaatgcgtggaaaagatgatttttattaatacattgtgactttgtagaaactgatcttttgaactatacataaacatttgcaataatgtgatcagtggtttctcttagaaaaattgagtttttcaacacatttatttggttataaatataatttgtttcttcaacagcttatatgacttgggatttatttgattgatttgctatatataaatgtgtgtattttcaaatattaatcattaactgtagtttaaatcatgcttaaattatttccatagtacattatttttcatttgtattatatgaaaagatttgtactatagagaagagattatagatatttactgcctttcagtcatgcccagctcatatttatatgtgcttcggtacagttttcttttatattttatacaaatctctcttgtaggaaattatccattctttatccccaaccattattttatcaagcctagcagttgtcctaccttgactattatgctgcaatttactcccaactctgctaaaatgtactttaagaacgcactcctactccttccattctcccagcagcactgttttcataatccccatcgtgtaaagtgtagaaagcagaaacttccatattaaaacttacaaatcatgaggctggtagaaattttgaagttgcagttaagttgtggggaggttttccttttattcacaaacggttgaagctgtgcttcgaccagttataatgtcgttttttatgtgtgatatataattactgattcgttatttatgcaaagacaatgcatcatcctatgaagaatattttggtccaaatacgtagctgtgtttagaaagtgttttctcacatggggacaataaaccatgaagaaaaaattaaaaggtcaccttaccatagagccaccaaaaataactttttaactttttttggaagctccgtaaaacctagttaataagtactttaatgccttttgattgaacacagttcccaattcgatatgtcattaatgtagtgcctggtagctggatgggatgtgaagagtgtaagaattagatttatatagggtgttgcctttatctgtcagataaagacaaattccagagagtgaaaatgaactggagtttgagtctttggttctcttatttctctttttccattttaagatagatctactccccaacggccgctgtcacaacagttactaatgggtttttctaatccttttttcttagaaatgaaagttatgtgctcctctgttaaccaagttacaaagtgtctcaaggcatttctgatacctaaaactgcttaaagctattattttcaccttcccaaaatatgacgacaatagtgcctagagttttataagtctataaacactatacatgcatttaagtatatgtataacccatgtaactgcagtgctacatttttcaagaaggtgatacatacacacagccaccaggaagaaaaattagtatcttgtttgttgtttttttcctccaccactgtatctagaactcctagaacagcacctagcacttaaaggtactgaatgtacatctgttgaattagtgagtgatggtctgatacatgtaggtgtggactctgagatagaagaagacagggcagtgttagtaagcgctggtactaaaagagaaaaccaaatttacttctttttatattgtatcctaactcactgagttaaatcatctagacatgtgcattctacaaatctatatgcatataagcatgaagaaattgttctaggtttgtatatactgaatctaaaacaatcatttatgaaaatgtgtgacagggaacccacatataattaaaacattactaacatttttccacatcagtgagctttcattatgtggttatgataagcagtagagtagagagtttagcaaagtactgtattggaacctgaaaagcttagaaagatttaacctgattgttgatagttgtacccttgggcaagtaacataagatatttaggcctgttttttaacgttgaaattaaatcagtgataataactgcccctgcctactcaactgtactcttgtgaagatacagtgaaatcatgtacgactgtgtaggaaaattcctgttaaaatgtataattatataaatttcaagatttgtaaaatgcatattgcttcatcaaacatcccaaattctaagaaagttataaatttccacgtaaagtatcctaaaaacaaattacctttaagaatgtgttaaacattataaaattgcatatttatatcttaaaaaactgtaaataaaatgttaaccacataaaatatacgtaaagttatttccagatgtggcaaatattctaaagctaaaaaaactttaaaataagagaatacatacaagctaagccacgtttgcttttgacaaaatcttccttagaggatcttacaaacttttgatcatattcttctattgtacagaatgttccttgacttgtgatggggttatatccagataaacccattgtaagttgagaattttgtatgcggaaatgcattcaatacacttaacccaccaaatatcatggtttagcctagcttaccttaaacatgctctgaacacctatgttaacctacagttgcgcaaagtcatagaacacaagacctattttatagtaaagtgttgaatatctcattcaatttagtgaatactatactgaagtatggtttcgaatgaatgtatatcactttctcaccaccctaaagttgaaaaatcactaagtagaaacattataagacgggggccatgtgtatttccgaggctagttgttacttattcaggagtaatttttttattcttctatttatttaaggtataaaacaaataactcactttattgtatatttatcttgaggtgcagaaatgcaactctaaattattccaagattctgtgtaccataacttttaccaagaagaggatgctgttttctagcttggttttaattgttgttttattttgggctttagtttctttatgaaatgtgttgatttattttttccatttctagttcagtaacttaaaacccattgttctaattgtgagttcagaaccatgacaaaaattattgaaaaatattgaaactctaagcaaagaatgatttaatcagtagtgtttttttctcttttttgctttggagtcttgaaatttgcttttgttgtttattttttgttgtctttcctttgccatttaaaaaagttagtttgtatttattttctcctggttaaatttgtaaccatgaacatattaaaattataatgctattccattgaaccttatgaattgtcaagtctttcaaaaggtttaaatattggcaatatcttatagtttaatacaatgacttgtacccaagtctgcttatttctgaatattaatatatatcattaaacatcctgatggaaaaaaaacaagaactttctgttgtaaatcacgtatgattaacagacaccaattcccaaatttaatttgccaaaccacaggcaaaaattaaatagtgttatcagtaaggaaatctatggagcttccaaaaaggtaaacattgagtagagtgttagcttcctgctcccatatcatgccttttgtttatttcttttctttcttttttttttttttttagatgtatgcatttgggtacagaacaattgtatgaaagagcgattttgcttttctgtcccctgtgtaaaacaatatgatggaaagcacatttccccaacatcagaagtattagttatatataaaacgggcataatattaccaaatatgttttctgttttaccaaaatagtttactgtcatcaatattaatttttgcaggtttgattatattttatcatgtatggtagctacctatgaagttgcttaatcatttatactaaattttcatttatcaaaataataagatgctcatgattgcatatgtaaatagaattaaaaagtataacatgaattttaaaaaagcatattccattcattggtgatcatcagtttttgaggttttcttggattgttgtattgctttggaatttttcctccataaaacctacctggccctcctctgctgagtcacacaacactaaagcgtatcctgactctaagaaatttgggatcatagaatgccatatattttgaactaagagaaaagtacttacttctataaaaccccctttgccatgcatgtgagtcaatttttctatttggattttctgtaaaatgatttaggcgatgtgtacaacttaacacaaaatgtacgtatcataaaaggactggtaaaattgttttcaatttacttagtgctgatggactagaatcattttatctgagaaacacttggatcagtaaagtgcagggttttttttgttgttctttttgttcttgttgatgctctgtggcatctggagaaatgggcaggtgtaattctgaataaaggacttttttcttagatatctaatgtgctgtgaggaaaccataaggaaactcagccaggaaatgcatgtggacttctattccactgttcaacagctaatgtcttgtaaaagtaaagtagaataaacaaggaattacctgaatagctcacgtctgaccatacctgaatatctatctacaatggttgaacagagtaacaaatcttagaggttcaatgattgaattcaaattggattttcataagcaagttcaactcaactttttacttcaagtcaacagatatttattaatgctacaagtgctatgcttaacattctaaaagataagaaagaaatattaaggaataatccttgtactctggtagttgataacattattgaatatacatattatagttatacaaacaagttagagagtaataaagacattaaggacatcatccaagcaaaaatatataagacatgagtgtaactgaaatcatgaaaagaagaaagcagcacaaaaagcagaaactaggaggaattttatagaggaggaatccttagcttgaggtgtgaatataactggaatctggactaatcttgaatgtaatagctgacagttattatttttgtgccaggacacattctaaacacttagagtaacttgtatggtcatcataacagccctacaaggaaggctgtattattatacccatactcagatggagaaacggaggtcctgagcagttaagtgacttgctcaggtgagatcatttttaaatatcatagttgaagtcccactctggatgttcaagctccagagtttctgctcttaagcactacgctatacagtttcttgatgcagaaaatgttttcaaagttaaagatacaaagtcagtaagggtaaaaaaaaaaaaaattgtatcagaaggatgtgtctgaagaataacaaagagattaatccttcactttgttattcactttgattatcctttcaagtgtctctgctggcaaagcactaggaaatcaagttggataaaaactgtgaatccagttttttcttttttttcctggaaaaaaagatgggctaaaagatgggcttgaaagtgtccaaaaagctatatgtcatcatggatggattttggtcagggataatccttaaaatggcaggataaattggacacaaggaaaaataaagagataaaacaataagtaaggagatatttgtgttcagcatagctggaccgatttataaaccatacccttgattcagtagctgtaccaggactctcattattaaagttcactcaggagatgcccaacatcctagatcacccattttcctgtgttagtgcaaaatgtggactggatttcccgatacatatttctatctagttaaataaatactctgattggttaaggaaaggttttctggaaggtgtatataatcccaccatggcaacagaaccaagagtctctgactgtctaccaacctgtagacttgaattttttccctgtactttcttctagcttcttcgatttctgttatccccaaaacaccttgatgtagccttaagcagaatcaaccatcaaagggctaactccctcctcctgctgggtgccttctctgttgggccccagcagcagtgaatctatgctcccaacttgacatttttcttatcccctttcccacctcccctaaataaaattcctttgtgtcaaagtttgatttaagtgatagaaatggctaagattgtctacagggttgggtttggaagaaaagaggtctggaaagggaatatagcaaaacatcagtattttctgagcaagtttggaagagattaaaaattacccctagtgactctcaaatttatatctctagtcaagattcctctcctgaatcatgacatatatatatatgccttttatatattcacttagaagtataataaacatcttaaatttagcatgttaaaatcttacaccctaaccttatcctcctgcagttttctacactatagttaatggcaactccattattccacttgtctgtgccaaaattcttcatgttatccttaaggcctttctctaccaacacacatgtaattggccaccaaatcctaaggattctgcctttacaatgtatccggaattcaaccctgcctccactctgatccaaagcaccatcatctccagcatggatgattgcagttgtctattaacaagtttccccctcattgccttctcccctgtagactctactgtcaatatactagccagagatacctatttaaatggaaagtcagattatatccccctttctgcttctgttcaaaacccccaatgctccccatccccctcaaagtaaacagggaagtccttatgttcataagtaccttcatgggttacccaccccattctctgatatttctctggtagtcgctagctcatacactccagccataatcacttcctccatgttccttggccactcctccaggcacattccagtgtcagggcccttatacttgctttacctgtctggaatattattctcatgatttttctttcaatggttaatttctgcatttccttcagatctttacttaaaaactgccttcctggtaaggtcttccccgacccctcttacctaaaattctgacccccactttatccttcatttcttccttccctgctttagttttgctcctcagcacttaaccactatctaactgagtatatagtttagtcatttctctatttgtttactttattctcctgtagaaggtgagattccagagagcggggcttttgctttctggatcactagtatatacccaagatataatatatgactgtctcaggctgggcgcggtggctcacgcctgtaatcccagcactttgggaggccaaggcgggtgaccacagggtcaggagttcaataccagcctggccaacgtaatggaacccgatctctactaaaaatacaaaaaattagccgggcatggtggcgggcgcctgtaatcccagctactcgggaggctgaggcaggagaattgcttgaacctgggaggtggaggttgcagtgaacagagattgcgccactgcattccagcctgggtgacagagtgagactctgtctccaaaataaataaataaataataaataaataaataaataaataaataaataaataaaatatgactgtctcatggtaggttttttcaacaaatatttcttgagttaatgaatgaatacagcgatgtagctgtcagacacagagagagaaacctagaagatagtattactagttaaaactagtgtggctaggtctgtatgatgaaaactgtgcctaactgtactgaatcctgccaaggagggaaagatgaaatggggaagctattactaagtgagtgaataggaatttccttcaggaaataaatatggttaaaaatgtgaattataagtgcttccagctgtctgctaatgttagtccttcagagaaatgaaaactgagaaaccattagaaagcaattttatcacttcttttaaaaaataaagttcaatatatttcaaaccagaatatcatcgaaatactgaagtcattttcaggggaaaatgccctgaaacaacaatttcatattatcttatattttaacttatgcttttatacatttgaaattttatttcatttgaagacttttttctaattgaaatttttgactgagagaacactcacaacttctgatgtaaaattttattactgaggaaaaactgttaaacagaagacaaattagccaattaatgtttgtatatacatcccacagtggacatattatttaaaatcttggaaagagttgtagatttgtgaaggtatatgtgagcttatttctaggtatgaaataagggagcaaagacacttgtaaattatagacatccttatttagtaattggatgttgaagatgaagaaatggctgaattgaatgaccacagagacgggacagaggaagtgatgtttgtttgtttgtttaattgtttattgagacagagtttcactcttgttgcccaggctggagtgcggtggcacagtctcggctcactgcaacctccgcttcctggggtcaagtgattctcctaccttagcctcccaagtagctgggattacaggcgcccaccgccacacctggtgaatgtttgtatttttagtagagacagggtttcacatgttggtcaggctggtctcgaactcctgtcctaaagtgatccacctacctcggcctcccaaagtgctgggattacaggcgtgagccaccgcgcccggctgctattttaaataatagaactttggcacttttcacagtattcgggaagcaacgagctttgctataggtacaaaaatatatttaaaacttcagtaaattattttaagtttactttcatcaaaagtgattaacagtaagttcaatttgtcagatattactctcccctactctagttctcttcaggttctgcaatatctactttgacatttatacacataagtttaccatttagatggtaaaggcaggctctgcaatgaaaatctttgacagcaagggagtagttgtcactttacattaaatggaagaaaaactaaacagtagaagtctatcccttatgataaagaatggagcatagttaagggttgcttcatacctttatcttaaactgattagttggcaaataggtcccttgtttgtttcctagataaattttctgtattctctggcttctccttttatcctgttaaagacacatactccacaacacttgaataaacaaagcatttttatgttcaaattatttctgtatgtgtctcctttaaaaaccaattatcttcttaagggagagactcacattttaaagtctttattttcatatctcacatttgaggctgatattatgtctgtattatcaataaacacttatttaaacaataagcttttcaaacagataaatgaattgaagccacatggcttatagatttctgcttttccttactttaggtatctggatttcatctgccggttgtaaaagttactgtgctatctaatttttctctattcacagtgcataatcagggtcttctttaacttattggagactgtgaatcagagatgcaaatatcctattttaaaatattaaggactcgagttgtataaattcgtgtacagatgcctttcagaaattaaaattccatttgtatgtatatttagaatttccttttgcagaaagagtggccaaaaataaacatcttacagaatttcagcggaatagtgaagtggtcaattcataggggcatgtcaaaattaagaagggatttgactaaaaagttggtactttatcattttgacatcatattttcagataagataaggaactattcagggagagaaatagaaatgctatattctatagtgattctagggatgtttatatcgccatagcaactacaagggactatggcttcctttttagagggtcagaaactataaagatcacttatttctagacaaactaaaatagtaaaatactatcagagatctcatctctgactttaaactatggaaagtgctacagcattttctttggtgcacataccatttttctgtgtgcagtgccttgaggacacgaatatgtgcagggactttaaaaaggatgtatttcctggactccagccaattttgacagcattctctgagaatgcaccaaggagctattatctagatatccagggagtgtgacatcccctgccccagtttttgctttttgcttttctcctttaagatagaaagttttcccgcgttagtaacatgctgtacagcattgctaaaaccgttcataacttgatgctgagcaatgctacagcattccaaagaattggtagctccccagagactcagattaaaatcaggaagctttgcaagctcaaatcctcagagagtatacatacacacacatacgcacaaacacacgcataccatatcaaagccataactggataacttttatatgctgatggggaagatcctttatctcttcccttgaatgtttttctccatgggtgcttacagctatgcatttaaagggtttgggcctgctatgtactaacaaatgtgattggttgcccaatgtgaatttaagtaatcagcctttcattcagctggagtcttggtatcaggtggaggacttggcagagttatgtatctttgccattggactggcagccaagcaagaatgatggagacagtgacttaaaagaattcagagttgaatcaagtacttgtgaaatcaggctgcccaggtcaggcaagttaacagaagcagccaagaagatatgttggtgcacgtttctggtacctgacctaatcaggctagcggagtagccctaaacattccacccaagactccaggcttggagccatcagaagatggtagtaaaattctaccaggtaaataaaagtaaagaaataatactagagatacgcttgagttcaatggcttttagggcattaataacaggtattacatccattgtatctcttttattataatttcaagtgtattttagattcaggaatacatgtgcaggtttgttacatggatatattgtttgatgctgagatttgggatatgaatgaccccatcacccaggcagtgagcatagtatccaacagtttctgttttattatgagttttgtttttatcaatatgaaacttttcttcaataagcaagcctctgatgtcaaatacagcatactgcaatgtcgtacaaagctattttctattttatagtgaaagatgatgacagcaaaagacagtctggtctgcctacatttatgttttccacttccaacatgctgttgttgctctcgataagatcaccaatgacctcctaaattgcccgagctgacttttccctcctggtcctggctgcatctgacttgttgacaactccctccctccttctggttctcttcctgggtctgatgactattattctttagggatactcatctccttcctctgcccatgctttccacataggttcatctttatgctacctttcttctcactcttttcaccctaaacacctttcctgagcaatctgaccatccctagtcttattcaacatcacacacattccaatgactatcaattctctatgtgaaattgctaaaagacagttttaacctgcattcctccagataagtaaattctcagattgtttctgtgttggcttgttctttcttttgtatggtaatacctgacctgtcagataagtactttttccacagagttaaattgaggtgcgaaacaaaagaaataatgaaagctttccatcacaaggtgtacatagactggaagagaatgccttgaaattttattttaaaaacaccttctttctctgaaattcactcacatcacccataaccattgtatcttatcctgttgctgagctgataaataagacacgagaacacagttgctttttataaggttcccattgtaagcattgacttttaccttttacaactgacattatctgtagtctcacctgcctcttcagcttagttcttgctcaaggcaagtcctcgtggaccacaaacgtgaaatcttagaataaggcagaaaatcctctaagttttattgttaacttctttcctgtttccctctctgattgtgaagttttcttcagagcccgtcatctggaaagctgtacgatcagcagcagtcactccctatctaacacagtctccaacttacaaatgattaaaatgcttcccaattttgactgaaaataggcaagaatattccctttgttttgggaggctgaggcgggtggatcacgaggtcaggagatcgagaccatcctggctaacacggtgaaaccccgtctctactaaagatacaaaaaattagccaggcgtggtggtgggcgcctatagtcccagctactcgggaggaggctgaggcaagagaatggtgtaagtaaacccgggaggcggagcttgcagtgagcctagatcagaccactgcactccagcctgggtgacagagctagactccatctcaaaaaaaaaaaaaaaagaatattccctttgttgatatttgttaaaatttatatttatctagtcaggaaacataagatctctggatgagagaatacatcattaattactcaaaagcatctcagggcaagatgtttatctgtgagtgcaggggttgtagtacaggagagaaatcccagaattgtggatcttggagattatatagagcacctgatgtatcaggaggagagaaagtgagagagacagacatacaggaagacagagactttgctctgggctataaaccaatgatctaggtctattatttttggaatataagttgaaatgtaatcaaagggctcttggagataaaagtttttaaatctctccagagcaatgcactaaactccaaggtacgcttgccattcagtcaccctttaagacagttactacaactctttgctcagaaagcctagtccatgtatccaaatgtgaaaatatgtatggctcagcaatccctgccatcttactcctcttctcaaaatctgatttcaactgcctctggaacatctacagtttgatgcctcaaaggcttttcagaatgaccatgtccaaaattgaactgatcacttatgcacacatacacaagcatgtaaccatggaacctcttcatctgtctgaaatcctgttacccaatgacaccacaaatcatgtggatgcccaggccagatacctaagactcattcaagttcttcctcttcttcacccaacacacagtcactgaattctgctgagctgttttcctaaacttccttcccacttcagctcaaatgtgaatagcaactagatacttgattcaattaatgaacttttgttaagactgtaggtgtgttaatggtattatatatgtactttccgaaaaaagttctcatgagagaatatttcagcaagagaaaaatgctgaagtatttatggagaaaataatatatcagtttgtttcagaataatctagttgaagaggtgagtgggtggattgtccatggagtcataacagttggcactggattatagggttatgggagctatttgtattattttcctactttcaaatatatttgaaatcttacataatgataactttttaaaaatcatagttccccattagctactgaagtacaggcagaattttctgttgagattcaaagcacattattgaacatcctcagcctctgtttcatgccccatcttcccctaagcttctatgttactgaaaaggcagccaaatatgactgcgcttgttacctagctttgcgtgtgtgttacctactagctctaatgttcttcccacttctactactcagatatgtctactgcaatttgcaccttcttcgtgaattctttcctgagcctatgaccaaatatatgatacatgttttctctaacttctagaaaatgtttggtaccacttggaacactcatttcttccttcttctcatccagctaaggcttctatacttggatttttttcttcaattcttcaaaccatatcctttcttactactacaataaaacctacttaaaacttcttaaaggcaaactaaactgtgtttcacccacctttgtttctgctatattgctccttacacatgggaagaactcaataaattttgctcagtggaccttatgtataatttagatgatcaaaataacaaaattcgtactaggaagaatagccagaatgtagtttttagcaaatttattgagaataaatatgtttagatttttctttcttcccgtataacccatttgtggtttgtgatttttccgttaaatagaatataaacaaaacattatggattaaatttatgggaccatctattcatttattcaacaaaaaagcttttgccatctatcatgtgccaagcacaggtttgagctttggaagcccaacagataacaacatccctgtagtcatagatttcaaattagtggtatataccggctacttgatatatattttaatgttagtaataagtactataaagaaaagggaagagtaatgccaggaataaagagtgattgctggtgctatttaaaatagagtagtagagaaggcccctttaacgtgagaaagaagtaagggaaccactgatagaaatgtgggttaggaaaactatttttggcaggtagaacagcaagggcagaaatcttgaagcaagaatgtagttgttatactcaagtaatgcaataaacctaatgagggtgaagtgttgtggactatgaagagactgggaagagatgagcttggaatggtaggtagtatacaaccaagtcatgtagagatttataggtcatagtgaagattatgcttttttaaaaaaagtaaaagcaagtttattaagaaagtaaaggaataaagaatggccactccgtaggcagtgcagtggcatgggctgcttgactcaggatacttgtagttatttcttgattatatgctaaacaaggggtggattattcatgagttttctgggaaaaggagtcagcaattcctagaactgagggtttctcccattttagaccatattgggtaacttcttgacattgccatgcatttgtaacctgtcatggcactgctaggagtgtcttttagcctgctaatgcattataattagtgtataatgagcagtgagaaggaccagaggtcacttttttcaccagcttggttttggtgggttttgactagcttatttacagcaacctgctttatcagcaaggtctttgtgacccgtatcttgttctggcctcttatctcatcctgtgactaagaatgcccaacctcctgggaatgcagcccagtaggtctcagccttattttacccagcccctattcaagatggagttgttctagttcgaacgcctctgacatatttcccctctttcttttacaagggaacccttaatcctaagggtagtagagttacccttaggattaagtagtagaagggtaatacatcttctgtaacttcttcaggctgaatatgggtgatgatatttctgcctaactattagggtctcttgtattcagggtagagaggagctcagtcagcaagcatcagcttggtgagggccattcataactgataaatggtgatatctggaagattagtaagttttcaatctaagaaaacattgagtaagcttattctgcattcctatacaaaaagtaaaacagcaaatatattccacaacagtaaaacacaataagtaaaattatcccaagtaaactaaattagaaggctttccgtgaactgggcagctgttggaaccaaagtgatgtggggctgctagctgattccaatacatgcccagaattagaatactgatccaggtttttatattacccatccttcttgtttcttctgaggtgcagtcagagatcactggcaggttcacaggaataagcaggatcagtctatattgcaggaaaaaactcaaaaacagctgacgagactaataacaggtgtaccatagttcttaaaacataatttttttctctctccagtctcccatttttactaaagatggatcatcataggactgatttgctttattatacttggcctgattatttgtataaagtgttgcaagaataattatttttcatgtaggcttttgaaattggctgtgattgaactctgtgatgaagagccaccagaagattttgagcagaggagtgatatgatcccaattatgttttaaaagaatcttttcggctcttgtgtggagaattatccagtaggggggaaagagcggaagcaagaggaccatttagataggtagttctataacccagatgagagacaataatagcttctatcagatctgtagcaagaaaggtagtgagaagcagtcaaattctgcatatgtcctgaaagtcaagccaaaacatttgcccaataatttgaatactggagactgaaaaaattaaggatggctccaaagttgtcaatctgagtaattgttaattgaattactataattcaattgaaatcagtaattgccatttactgaaatgagggaatctatgggatgagaaggattaggaaatgcagttcagaattttgtttgcgtcatattaagtttgaaagtctcgtgagacctccaagtgttgagaaattagcatttgttagactggagttcggaggagatgtccgggcttgagatacacatttgggtgtcattgtcttatataagatatttaaaattatgagaacaaatgggatggattatggacagagaagaaaagaagtgcaaatactgagtcagagcactctaatattaagatcaggatgagaaggatccagcaaaggaaagcagaagaggtcaggatacagaagccaaatgaaggcagttttaagatgtagggagcgatccactctctcaggatgaggtctgtgatttacctattgaatttgaacatgtcaaagtcactggacttcatggttattaactttaaaaagtcaataattaagaattgcaacaccatttgctacctttgggatttgtatatatatatatatttttctctttctatagacagctaattcatttttttactgttttaaaatttttatattacagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggtaggtaacacatatatttttcttgatacttgcagaaatgatttgttttcagggaactgtagaatttatttcagtaccctccatggaaaaaagacagggaaaaagaagtatcactctcattgaaaaatggtaagtaaaatgagaacaaataatgatgaacaattcagacaaatgagctgaactgtagaaattattcagtattaaatttagcgttatgttgaagcattatatcttctaaaatttcaggtaatcgtaaatcagattggggcattgaggtgctataaacagttgttcgatataacatatttatctttagtcaaatctgtatctacaaatttataggagtttgatacttagattaacatgtttaaaatactacctatcaataaaaaaattgattttcatttatttatattttggagggtgacactttacactttgcattaccctcccccacatttttttttgccatggggaatttgttaagttgatttaaaatcatgtttctttttatcttaattgaaatatttagctgttgacttaattggggggtggcagaaattcaattacattatttagcttcacatcacaagaagtggattactctttcttttacatttttagattaaaagtaataaagttctctaacagcttaaagtgattcatttcagaagtctttatcctcaaggtaggcttcttaattattctcagaggaaatcaaatcattcgtctaataattatagggaacctccatggtatctcttacatctgtccatttctaaccatctttactcctattttagttcttggtttactacatcaggcacctaaagagagatttctagcattaatctcagttgtctcaagtgattatctccactttgttctcaacgatctttcagtggccgtcatttttctaaagtgtaagagctttggtactataatctcattcccttgagaatgaaaccctgactccttaattgtgcaaaattatctggtcagcctcactgcttatttcttcgtgcctgccctatagcaagcccctccaattatgttctagcgatattaaatcaatttgcagatgcccaagtgttttgtactccctctgacctgcctgttcttcaggtctcacttcagatgttgtctttttctagaaatcctaaaactattagtcgctcctaacatctggaaacttggatattgtttcatcatttaatgtaatttaatatcaataaatcatttatgcatttgtaaattttccagacttggtggctaccgtgtagaatatatgatctgatgtgcctgctcctaaaacctaacacatagtaatcaatttgtttacttttctgcctcccacacaagctccttatagaaaagggctatgttttatttgtgttatatgctcaggactgatatagtgctgagcacaaagtgggtgttcaatgtgtctggactcaagcctcctctccgaaacctgagaatatttcccctttggatagtctaccagatttatctcactgcaccttccagggcaggtgcggtggctcatgtctgtaatcccagcactttgggagtccaaggcgggcacatcatttgaggtcaggagtccgagaccagcctggccaacatggtgaaaccttgtctccattaaaaatacaaaaatgacctgtgcgtggtggcatgcgcttgtagtcccagctactcgggaggctgaggcaggagaatcccttgaacccaggaggcagaggctgcagtgagcccaaatccaccactgcattccagcctgggtgacagagcaaggctccgtctcaaacaaaacaaaacaaaacaaaaaaacagatttatctcaacttccttgaaaatagctggtcccacagtatccaaagccaggcttgataaaggcaaagaaactcagccactctgtgtatatgctacaaatacaaacttaaacttataaaatggtggctcatgcctgtaatccctgtgctttgggaggctgaggcaggagggtcacttgagcccaggaattcaaggctgccacgagccatgattgtgccactgtactacagcctgagtaacagactctctctaaaataaattaacaaaaatatttgaataaacttatatcgccaccatggtgtactttctcccagcatttcacattgagacattatgaggctctgcgggctactccaatgatgtcagtttcattaccatcttttgggatgttcattccactcttgggaagttcttccccctctggtttgtcttcttatagtcagtgttttctccaagcattctaggccacccacaccatcccctaaggaccgttgaggtttcttggatagccagtgattactgtgcttctatatacacctaccagttttgcactaaagtagaaataacgctttctgctttttgaggtttctcctccgctttactcatgagtaatttttggcaaatgatccaggtattcccttctcactgggtcatatggacatttccctttcagtttaccttcaccttagacttaaacagaaacactaacgccattccacagagagggtcgctgaaatctcaccccaactctgaggacttttctggttttgacaaaggatagagtttctctagccccaatagatccaccctgtccttatccagaggttgaaattgtacttccattgacattctataggaattggtcaggagctgttaaatttcctatgacttttagtacaatctcagatacaaactgttttaagtaattgcttataagcacaggctctagagttccaacccgttttggaattctggcctttctgctatctatgtgcccttgagcaagtctcttaaatcttctgctccatacatttctgatgtataaaataggataagaatagtgtctatgtcacagggttgttatgaggattatctgacacaatatatgtggggagcttagtgggttgcttaaacacgataatggctcagttaaggttggcaattttgatgatgaaaatggtgatcttatggttctgatagtcatgatatctgttaattcattcttacatgctttcaaatttccctgagaactacagagagaagaattagactcagtccctgctttgaagagcttcacagtcttggagagaaaaggcacaaccagccagtaaaataagggttgatagactggagctgtacaagagggcaagaacaagatccctggggaatggaatgaagctatcttactaagaatggggaataagtcaaggtctatagaccattcaaggttctgagttacaactaacagaaagtgactctagttactttaggtagaattatataaattactagaaggatatcagatacctcatggaatcaataggaaagcctgagagctaggtttaacaatgggcagaaactataaaggaagagcaggctaggcatccagaatatatctactatcaagctatgaggtaaatctgaattattttgctgtcatgccagagtccattgctttaccaggagcaccattgcactggacattgcttgctatcgtcactgcaaaaaaaaagtatctaaattatttattcttgctgtgtgtcgctcattctacaactagggtctctggcagaagcatctgatagtcagaggatggatatttttttctgtaaaggggcagttagtcgatatttttgtccctgcaggtcatgtagtctctgtcacaactactcaactctgctgttttagggtgaaaaaaaccatgtataatatataaatggatggacatgttgtgtttaaataaaactttatttaccaaggcagatggcaggctggaattgctgatgggccatagattgatgactgctgttacaatacaggtttaggccacagaactaggttcttattgccagagatcagggaaaataaatagctgaatttgttcttcattgtagtggcagtcaacacctcgtgtcctactaagtcccatacaatggtagattcttgaatccttggagagatttagaagctatgcattcctgaatacacaaatgttcagtacagccttcatgtggtgttctcaacaaaaatctgctgagttttttagtaagccaatttgggttaaatcaaaataaatttgagctagtaagaagggctatattggtatttttcttaaatggtacatgtatggtagtattagctatgaccgcaataatgctgtgacacaaatcaccctagaacttgctgactgaaaacaacaggcatttctggctgtttaggttacttgtaccttgactgactcagctgggcttggccgggaagctctgcttcaagatgtgggttagtagagctaggttccatgatgcatgttggattaaggtctgctatatatgtctttgctctggacctaagatgaagggtcagtgacatgttttcatgaccagtcaccaaagtataaacctaaacctcccaagaacactcatggcctctgctcctgtgaagttcactgacatttgattggccaaagcaaattacgttgccaaatctgacatcaatagaatgagaaagtagactcttcctacagtggaaggggggagagatgttaatatttgctgaaccataattcaaattattagagatagttaataatttataacaggattgttttacagctagaaaatgccttagtggttttgccctgcttcattattttataagggagaaaactatatttcaaagatgttatgtgacttgcctaagcacatactaaatagtacatctgcgtatttctcgttcagtcatctctattaaatgtcataaggtaaaacagacattacgctttagatgagaacaggaagatatttaaaaagccagactaatttatgactgctcattcattatctaacatacctgcttccatacattgtctttcagcaaatagaatttcaacatgtatctcaacaagttacacatcatcaaagtattaaaagccttattttcacggacattctgattgttcactaacagtcaacacagtcaacagtaaatccacaagcaccatgaacgtatggatagatatgcctatatgtaagattactagttaactttttgggaaattaatattactgctaaattcagttttcattgattttcgggtgggtaactaactgcttataaaatatacctataggaaacatgtaaaaacaaagaatttacataagatctatctgggattagagaaacaaagctcttttcttctttcaatgaacacttaagaagggcctactaaatgtcagatgttatactctattgtcgttagtttctttctgataccatctttactatcctgtaagccattagtgagtgtttcccacttttagaaaatgacttcccaaagactaagagggtagaacagttcaaatgctatcatcaaaatgaaggcagtttctagactacaaattgctgtacagccataagatggcattattgtgtaacaacaaggtccctgtcaaacatcaagaaagtaatgttttaaaatcagtatttccttcttggaattctacttagtcagatatgttgggttgacttacccacccatataagtagttaaattcaagatggttctgagctttagatatgatgtaaaatagacatgagactaagagtatttatttctatattattacatttctatagcaaaaaaagaaacctctaaaaaaattagagaaagaagtataagggcatttaattaatcaaatgttcttattaataatatttcataaaataaaggaaatgttgaaaaataaaatatgaacacagtgttgtataaagtaagtcagaaataagagaacacttactgtatgaatctattatatgaaactaaaaaattaggcactttggagtttagaggtcagataggagttacctttgtgagttgtgattaacaagggctgaagcaggcttctagggactgggtaatgttttgtttcttgatgtggatgctgcttgcattgatgtgtttcctttagggaagtttatggaaccatacacttgtgatgtgtacacatttctgtgtgaatgctggactgaactaaaatttatacttacattttaaaaataataaatatgtactttaagtacaggagggacataaatcataattgttttaataaagaaggtgtagctttaggaaaagcataccgcattgttctatttttggcatttcaccatggacccctgaacattttataattgcccagtacagcctgtcagataaatatgtgggcactactgctttagagaaagtattttccaaatttatcaccaccattctggaaccacagttccacaggtcattaggatgctgagggtgggacagttggaagctgcttccccagggatttctccattgttcagttctcatagcagtaagcctgcagcattaaagcactcacaggctctggctgccatttgtgctacatgaagaaaaatgagaaaatgaaagaaacgaaaggagagaaaacaggagtagaaaccaaataaatcagattcgaagagaaagtccctaatcgtctctgtattcagacagtagggaatgagcatgcaattctgcaagcccattcctaatgtgagtttctgataagaatttgctatctcagttgtaatctttctactgagacattcaataaataattttctttcatgtcaaggtaaggaaataacctcacattacccatataaggaaagaatagtatactaatcctcacgttatcactatagaattttatcttttaaagtggaagctagagggacagatgcataatctgggagcttttccagaattgtttgttcctaaatgagacattcagctatagcagcattagcagcctcttctatttgtcacaatgccatatgtagttgggaagatacatgataagcacatacaggatgctgacaactcacgaaggattatcattgcagtcttagaattaatctctaccatatttgaagatttttatgcaagactggatcttcattccacaacccaggtataggtatatgtgccaatacaaaatacttactgttggtttctgagcttggtagaattaggaagtaaggggtaaaaaacaagcaagtcctgaacttaagaaagttgttcatatcctattccatggccactgttttactgactggaagaaaggaatcccgtggattcagtcatggggacaatgcagaagaagatacagtagacagacagagaagtacaaatttctatttatgttccacttttcaaaattttttatctttaaatgttatttttaacgtttgtgggtacatagtgtgtatatatatatatatatatatactgtatatatatatatatatactgtatatataaacacacatatataaatatatactatatataaacatatactatatataaatagatttactatgtatatacacacatacatagtgtatatatgtggggtatatatatatgtggggtacatatatatatgtggggtacatatatatatatgtggggtacatatatatatgggttacacatatatatgtgtatatatgtggggtacatatatatatatggggtacatgagatgttttgatataggcatgcaagtatcatggaaaatgggatgttcatcccctcaagcaattattctttgttttacaaacagtaaaattgtatttttttaattgtttaaaaatgtacaattaaattgttttgactatagtcaccctgttgtgctagcaaatagtaggtggtgttcattctttctaactattttttgtaccaagtaaccatttcaacctccccctcaacccccccactacccttcacagcctctggtaaccatccttccaccctctatctccaagtgttcagttgttttgatttttacctgccacaaataaatgagaacgtgtgatgtttgtctttctgtgcctggcttatttcatttaacacaatgacctccagttccatccatgatgttgcaaatgaaaggatctcattctttttatggctgaatagtactctattacgtatatgtatcacattttctttgtccattcatctcttgatggacgctcaggttgcttccaaatcttggctattatgaacagtgcttcaacaaacgtgggagtacagatatctctttgatatactgatttgctttctttgggatatatacccagcagtgggattgctggatcatatggtagccctgtttttagtttctgaggaacctccaaactattctccattttggttgtactaatttacattcctgccaacagtgtacaggagtccccttttcttcacactctctccagcatttgtaattgcctgtcttttggatatgtcgttttaattggggtgagagaatatcccattgtagttttgctttgtatttctgtgatgattagtgatgctgagcatattttgatacacctgtttgccatttgtatgtcttcttttgagaaatgcctattcgaatcttttgtctattttctgatctaattattagactttttcctatagagttgttttaactccttatatattctggttattaatcccttgtgagatgggtaatttgcaaatattttctccctttctgttggttgtctcttcactttattgattgtttcactgcggaggagctttttaacttgatgtgatccatttgtctatttttgcttttgttgcctgtgcttataggatattactcaagatttgttttacccagacagatatcctggagagtttctccaatgtttccttgtagtagtttcttagtttgaggtcttagattttagtcgttaatccattttgatttgcagttctctgatggccagtgatggtgagcattttttcatgtgttttttggctgcataaatgtcttcttttgagaagtgtctgttcatgtccttcacccactttttgatggggttgtttgtttttttcttgtacgtttgtttgagttcattgtagattctggatattagccctttgtcagatgagtaggttgcgaaaattttctcccattttgtaggttgcctgttcactctgcatcaattttgcatcaatattttttgcatcaattttgcatcaatatttatcacatggtagagttcagcagtgcagccatcgggtcccaagcttttctttactgggagagtttactaaggcttcagttgtgttactcgttactggtccgttcaggttttggatttctttatggtttaatcttggtaggttgtatgtgtctaggaatttatccattacctctagatttttcaatttgttggcatatagttgctcatagtagccactaatgagcctttgaatttatctggtattaattgtaatatctcctttctcatttctgattttacttatttgggtcttctcccttttttcttcattagtctggctcaagatttgtcaattttgtttaccttttcaataaaccaacttttcgttttgttgactttttgtatgttttctttattacaaagtcatttatttctgctctgatctttattatttctttcttccactaattttgggttcgatttgctcctgcttgtctaggtctttaagttgcattgttaggtgatttatttgaagtttttttcttttttgatagaagcacctacagctgtaaatttctctcttagtactagttttgctgtatcccataggttttggtatgtggtttttctttcattttttgaagacatttttcaatttccttcttaatttcttcatagacccagtggtcatttagtagcatattgtttaacttccatgtgtttgtatagcttccaaaattcctcattgttgatttctagtctcattccattgtggtcagagaagatgcttgatattatttcattgttactgaatttttaagactgcttttgtgacctactgtgtggtctatctttgataataatctgtgtgctgagaagaagaatgtgtattctacactcattgaattaaatgtcctgtaaatattagatccatttattctatagtgcagattaagtccaatgttactactttggttgagcttctgtctgggagatctgcccaatgttgaaagtggggttgttgaaggctcctgctgttattgtattgaggtctttctctctcctgagctcgaataatatttgctttatatatctgtactccagtgttgtatatatatttgctttatatatatatactccagtgttgagtgcatatataattgttatatcctgttgctgaattgacccttttgtcattatataatgaccttctttgtctcttcttacagtttttgtcctgatatcgatttggtctgatataagtagagctagtccagctatgtttgggtttccattggcatggaatatctttttccatccctttatttccagtctgtgtgtagctttataggtgaagagtgcttcttgaggtcaacacaaaattgggtcttattttttcatccattcagacactgtatctatttttcttttcttttcttctctctcttttttttctatctttctttcttttcttttctttcttgagacagcatctcactctgttgcccaggctggagtgctgtgacaggatctcagttcgctgcaacctccgcctcctgggttcaagagattcttgtgccttagccccccaagaggctgagattacagtcacccacaatcacgcgtggctaatttttgtatttttagtagagttggggtttcatgatgttggccaggctggtctcgaactcctgacctcaagtgatccacctacttcggcctcccaaagtgctaggattacaggcgtgagccaccatgcctggtcgagacactgtatctctcttgattggagagtgttgtccaggagctgagcctagaaatgggtcctcacaacactgtccagtgccctatcctactgtgactaagctggtatccaagatgcaagacagaatcctctttacttttcactctcctctccttaagcaaaagtaaggagtcacttttgttactgtgggctgcactgcttgaggtgggggaggaatggtgcaagcactcccttagccatgccagctggtgtctccctaggtcacatgccaccctagtcctctagctcttagcccaggctatgactagaagttatctaggaattgcagttcgtgtgtcccagactgcctctcaggtttacctgggactccagagcactttggcccacaatggtgaggcttgccaagaaacttgagttctgactgctgggatgggcgattcccttctggctggggctagttcaaatattccctccgtgcacaggcactgactgaggccagcatggcttttttctctactgtgacagcacagcagttagttcaatgtaaagtcccccagtagctgtactgtcccttccaaaagtgcaaagattccctctctgcactgcacgtccagtgctgggtgattgggaaggtgtggtgttggtgattcaagactgtgtctcctgcctttcctcaatgcctcttttagcaagatgaagttaaaaccaggtaccatgattccgtacctggtttttggttctggtgacagtgcttttctgtctgctcatagttgttacaatttgatgtttcagtgagggagattagttatataggcttctattctgacatcttgcaccactccgtctcacttttttgaattgttgaaaccatggtttatggggaaatgttctgttctggtttttaccctcaagatcttctttgaaaatcatgatttactaagtaactagttggatagaattcatttttaagaaaataatgaataagtagttcccttagatatagcaagcaatgttcttataaactgacacaccaaaacacttaccagttcacctaaacactgaaagtatttaaaaatttatttttaacctttaagtttttctccatttgagtatcttgtgcactatacgctctcctacatatgtctacaatctttggtctgatttattttattggttgttgaatgtcagaaaccacctgaattttgcttgtatatataatgcccagtagagtgcacattggtaatcaatacgacttgatgataataatggtaatgaacactataatttgatagcatcaacttggcatgtatgccagaaataaaccatcataaacttcgagaaaaacaagtctcattaatctgtcatttattataatctccctccatcaagcgtagcctctatatactgtcttttttgccatatgtaagtttcttcttgtatatttcagattagagcttgcctcctcccacacactatcttctatttcacactgctctgttcaagtgtttatgtttctgctgaaggctgtataatctaagataatccctagctattgtaaatatcattcactggccagtcattgcattttgcacaccactgagagagtgattgtgagccaaatagaggagattttgtttccacccagcaacccaaaatgaattgtgtgatttgactattgatgccaattacatggaagttttactaccagaggcaaagctttaaactgcaaaagattaaccccatatagttggtgtcatgaggtatttaatgtatattggactatcaaagcgtctccttacaacaaaccaattatcaatgaataatattcttatcttattgtgacttattgaaactctttaaaaaacatgaaccattcagcacactataccgtctaaattagatatctaaactagccttcatttacatttccttgtttagttttaaatataatttcttctgaattcttagttgttaagagcaggtggtgaaagaatttaaagaagaaaatttgttgtatttattaagtgaaagagctttttgaaatgcattaaatagaagtttgtttctgcccatcagcttatcttctgcatattcctatttatagttcaaagcacttaagagttgcagagtgatttgctttttatgatcaccgcttcatccaggatcatttgccttatatcttcaacattttcagattcttataaatcttcacagttcacttagaggttagtttaaaactttcttcagataagaaattgactagatataaaattcacataatctcagagttagccatagatcaatatccccagtctttttctcaaagtaattgaacatttttgtttcccaggatagttgtatacaagcattttcatcctcaccatagatgattcttgttcttcagtatatgaggggactgtatttgcctgcttgttatctaaataaacatttttattattgtcaaaggaaaaagactctaatacagaaagaaattttgtgtccataggactagcctcattttggaggctgatattaatatttgactttattcattgtgtatttcttggttttgtcatttcacaaatttcccttctctaaatatgcattttttctctacctggaatagatgagttttaaaagacattactgtaaaataaaactgtgctaaatgtacttttcccagaaactctctttattttatcaattataatttgctttggctaagtgttacagaagctcaaggtagaaatgacttaaataaaagagaagcctatttctttctcctgaaaaaccctggaagtttgcagccaaggcagatatgttggccccgctcatttctgttttctactgagtgagttatctttacttggtggaatttcatccacatgttgcaagatggagctctcatgacatccacattccaagaaggatgtaagaaggccagaagaagggtcaaagggtgcataccaattgtcttttagggaagtttcgtgggagctgccatgttatatttccacttacgcttcattggccagatgtctgtcacatggccacatctaagctgcaagtggggctgggaaatgtgtttatttcacatgtgctctgctaaaaactgttcagtcatgaaaaaaaaaaaaagaatattggaagagaactaacagtcttcaacatgtatatttaaaaagagcgttatttttcttttacttatttatttttttttgagtgagagtgttgctggggctggtctcaaactccctggatgaagtaatcctcccacctcagccttctgagaagatgggattacagaggcacaccactgcacccggctcctgttttgttttgttttgttttgttttatttaaggagccctaagaagagtgtaaaaagggcaactttgtctttagttaacccttccctttttttttctttcctaattttatgaactctgattcagcccgcatcttactctggcttactaaattctgccaatataagagtagaagttttcatcatttccctaggtacctactcttctgtttctccatattctcaaagtaatttctcattcatcaacttttgtctgacttagatttaagctactgcttaggaaatgtgagaaatggagaatttggttgtcatagcgctcctacttagagggctaatgctttcctaaattttactaaagttggatcctaagttatataagttacctaaatttaattagcaagttttgcttactaattcactgactaaccactataaaacaaggacctaagtttaaagctgatattatgacaatgtactgaaatttcaagacattactttttctggacacgtaggatggaccttgcataagataaaagagcttatttttaggcacacctatgtgccaggcatgggttcagagccttacatatatcatttcattctcaagagaaccttaattttagagacgaataattttgagttttagaataaataattgtcttaagctcacacatgaagtatgtgccagagtctatatcgtgaccccagttatgaattcttttccactacatagcctgcctccatggcatttcacataggatttcttatgctcaaggattatgttcttccttccagatctatagacatcagtagaaacaacacaaatacgtataatgactttttaaagtctcatatacaagaccaaagtactttaaaaagatgtttaaatttttgaaggtgatatctttatgttcgagatcagtagcagaaatggattgtaattcattacaagatgcttagcaaagccaagtggtaaaggattttctgatgtgcttgaggagtcctgacttgctccttagcaaattcctacacaccattcagcattcagtgcaaataccacctcttggaatccttctctgttcttgatcaattattccattgtctggattcatagaactctctgtttacctatttatcttacaggttattatcatgagtttatatgtcttacatagctgtttgcaacatgttaccattcagtggagtactttttcctacagggaagaggctgtactatataccttttgtcacccctaagtggaatgcagtatggtttcatgttagatgttcaatacatgttaatattttattgatgagcccttaaatgtatataataagcttctcactcaaaagctgtaatattctagaatgaataagtttcttgagaaactctttggttaacagaatctccatttccatcatagtgtattcaataaattattaatgcagggtaaatttccttatatttcctttcatttcgctatactaaggtcaaatcatgacttttaggtgtggatacagcaatatataaaataatctaagacctggatatatgtttttctaattagggaattggagatacatgaacagtctctcatagagaaaaatatatccattagtcactaaagtcagtataacattctggtgaaaggtttgcttgcttgcttgtctgcttacttgcttgtttcaccttctattctaggaggatgtttgtcacaattatgaaattctaacgctttaaaaatctgtttaccctatgaaagttgcaaattcttgcctgtaaggcaattttcacaagaattattttcatattagttttagtttatccgtggatagtctcaaattcctcttgaaaatatcagtgttctcaagggaaaactgcccattacaagccacagatgtggttttttgagagatttctgcctgaaatacaagttttaaaatattctttgtagtttcctagtatggctagatacttgtaggaaatgacaatttagatgcacatttgaaaattcttagcctttgagtaatttatatgtttgaataaatttaaactatctttgttcataaaaaggcaaattttgtctgtttgtcttgaaatgcttttttagtttcttcttcagttctttcacttgtctttctgtaatattcaaaattatagcatagtacttgaaaaccaaggatggtccagtctgtgtcctttgttttgaaggaattttggaatcatcagagatataattctggaatttctttgggtaccttccataaaatagtagcatcctgataaggacgtagatgctaacttttatttttatctcattttctttcccctatctctcagtaatgtaggagtgacccaaggtagctgtttattgggccctcaccaaagtcaatcaatattagtcagctacaaccacaataatgctgtgtgacaagcataccccaaaagaacaataagcacttatcctcatattcacaggcctactttgagtaatctctgattcagaatctgactgtaggttgaccaaacatgtctgatctatgtgtctcattctggggctcaagctggaatggcagtagatatttggggcacattcctccatggctgagttctaaagatctcagaagggtaagcagaaacacatgatggttcttaagacccagatttataactagcgttctctcttccatccatagtcaattgtcaaagcaagtcacgtggcatatccaaagatcagggatagagaaatacacttggcagttagtgaacccatttcaagagtgtgggtgtataacactactacaaaacagaactgagacttgcaacttgaaataccacaccattctagtagaattttattacagtattaattaaacatttttgataaaacacagacaactctgttagaaagcccaacttacaatttgttgatcccacttggaaaggtattctgaatccattttttcacaagttttctttctaattcaatgtgttggggtacttttattttacccagaaaagtaatattataaagcataaagttaatgccccctgtaaaaatagaatactgaaacaaactttaagtcacaattttattatttactgacttgagaatctccttgtgcttcagcacacttggtagttggatttccaaatagcatcatgactttccatacccagctgtctgctgctcaaaactaccataagctgactatcacagctcacaggatacccttgaagaagaccatctggtttatgtctcttggcaaaatttgtttaaaaacaagcagctgcatgacaaagtaagaaagagtctctgtctagctgtggtaaataagtagctttgcaatactcataataaagcatttttctaatccaagccaacatcttcaaaaggaaagcattattttcttacaactgaaagaaaaatctacagaattcagtgatgagggaaggactccattaaatttgtttcagcagcttgagatagtgagaaaaacaaaacaaaataaaaacctgtttgtgattagatacagtcttgtaataactagttttaaaagtatttatttagaatctaatacttggatattattttaattctttatattaagagatttacatttcataaaagcttgtcctttgaaccctaatactcatattgtgatggtgagccggaatgagtaaggtcacttactatatagtcggtatataataattcgttgaataactctctctcctcctgttactggcagtgaatccatacgggtcttcagcaaccttaattcatgcctcctcagaagaaagaattcgaccaaggaggcataaggcagaagaagagactgaggcaagtgttagagcaggaatgaaagtttatttaaaaactttagagcagaaatgaaaggaaataaagtacatctggaagggggccaagtgggcgacttgagatattaagtgtcctgtttgaactttgatttatggttttgtattttggcatacttccatggtcttatataccttctccccaattcttcccttggggtagggggctatctgcatgcacagtggtctgctgacacttgggaggggagcatgcacggtgtatttactggagttgtattcaagaggtgttcccttaccagtcaagtgtttccagaggaaggtcgtataccagttacactatgacattttgcctcttagtgcgcacgcgggagcccatttgcccaactcctgcgatcttatcgggaagctgctgatcaccaatttcaggtgtttttatctattgggagactgcctttccctggtattggctgtgaccaattattattttaaagacacagtttaataaccacctgactgaccatcacttgatggttgcctgacattcctggttggggtggcgggggtggggggtctcctaccctgctcatatctgactagctatctactgtaacactactattaggtatgtctgtatcccattacactcactctctattacaaaaaagagtaccttattcatttttcaaaagaatgagtgaattttctgctccagttaagtgcttttccttacctctatgtagagtgtcaaactagccatgcttaaggattgattctggtattaataatataaattcttgcattatgagtgtctcagtttgggttcttacataagcaaatcctgagacaaggatgtgagttcaaatagtttctttgggcagtgattctaggaagctgtggtaggatgttggagttgtgagaaagttaagagaaagcaacctgtaaagagtatgttatcaagccaaacaccactgtgagaactagggcttaattccctggagaaagtctgggaaggcataaaacacttgtctcagagttatcttagacaaggtgcaggagctgaggtgtttatatttcaactcttgttagtcacttttaaagggccgctcagggtgtcagggtattaatttcctcttgcaactacttccaacctgtttttgcatgtggttgtagctactttttctgcgtcaaagatagactttaggctaagacatgcagtttccggctgtaggacatcaaccagagtaccctggagtgtccaggcccaagataatgggtgagctccacctggatctgtggcaatgtgagggaggggcattattaccctagcaagggccactgcacttccctatccagctggtcactcttctgcgtatttgtgttacttttctgactcctgcattcctctggatcctgattcaccatcagcttttgtattctgaggcttgtgtggctgtgtctttctatttcttccttattgacttacttgtttaatcttttgctaatgtatacctttgatattcctatgtactcacctttggttagctctgtgaattattgagtcttgctttacagctttaaaaagatcatagccatggtttgttttttaagtgtgattcataacagttagtgacaaaattagaagtggaaattaaaggtcacgtgcacaatcctacacaagccaatttcttgaacgacataaaatacttgaatttgtcttttactatcaccaatatagaaataatttgggggtatttctcaaagtattgatttaacaaaactttatttttgtgtgaagattttttcaagtctcctggaaattattcaaattattgtctttaaagtcaaaggaaaggttaatattagggttacttttctttggtcacagaattgctggaggcttctatgacttgctttgaagcagctgactttatgcacagttttggttagaaattcactaccaattccaacattttcaaagtcctaaaagaccaaaagtacaattcttgaaatatccctagagaaagcaagaataaattagttttcactagaaatgaagacaaatttttctcattagttcattttgcctcatgatcagaattctttgccacatgaaaatattttggttaataggttgtaacataaagagtaatatgaatagagatctagcccaattagatgacagaaaaagagcaaagcttttgaaatgtataaagaagaaagtttaagagagacatgaacaaggctggatgtagtttaaggttgaagaacacagaaaaatgagataagtgaagttaagtgaaaatccttcccttactgagaagaaagagaactcaaaattatgtgaaggtttttgttttactttgttttgcttcttaataaggaaacaacagtggcaaatctggggcattaggaatggtggaacttctataacagtgatgtttcaaaggtcacaaaggaaattaaattgtagattgggtttaaaagcactggaattacttccagccccattttttcaggattttgtatgtagcaggaaatagatcaccgcatagctaaaggggagaatttaggttttaactggtctcagtgcaaactgcttcatagttcctttgcatttggtggtgtatgtaaaacatgaaaggtataaacatttattatcataactttattattatacaactatttattggctgcataggaccatgtgtcttcttgcaggtataatcaaaaataaaaagacagaaatgtatcttatatgaaggctgccattatcgctcttatcaatggccataaaatcagatttcttacatgtacaacatatgaaaatatattaaatatgaaacgttttccattaaataattctgtaaatgattttcataacatttctgtccatgatgtgtaaatctgtagatcaaatactgcaagtgtacagaacttaaaatgctttggtcaaaaaaattctcttattaatatgacaatggcgttcaaaagtaaaaaggtaaaaatacagtttagcattaataagtaaactcagaaagtaaaatatattgatcatacagtctgtattagtctgttctcatgctgctctaaagaactgcccaagactgaataatttataaaggacagaggtttaattgactcacagttccacatggctggggaggcctcagggaaaacttacaaccatgccagaaggggaagcaatcacatccttcttcatatggtggcagaaaggagaagtgctgagcaaagggggaaaagccccttataaaaccattggatctcatgagaactcactatcacaagaacagcaccatggggataaccgcccctgtaattcaattacctccaactgggtccctcacatgacacatggggattacaggaactacaattcagaatgagatttgggtggggacatagccaaaccatatcatttcatccctggcccctcccaaatggcacgtcttcacatttcaaaacacaataatgccttcccaacagtcactcaaagtcttaactcactctagcattaacccaggagtccaagtccaaagtctcatctgagacaaggcaagtcacttctgcctaggagccataaaatcaaaagcaagttagttactttctaggtacaatggaggtaccagcattggttaaatacacccattccagatgggagaaattggcccaaacaaaggggctccaggctccatgcatgtcaaatccaatgaggcagtaattaaatcttaaagctccaagataatctcctttgactctgtgtctcacatccaggtcacgctgatgcaaggtgggctcccacagccttgggtagctccactcctttggcgttgcagggtacagcccccttcctggctgctttcacaggctagcattgagtgtctgtggctgttccatgcacacggtggatcaagccctcttctcacagctctactaggcagtgccccagtggggactctatgtgggggctccaaccccacatttctcttctgcactgacctagtagaggttctctctgagggccccatctctgcagcaaacttctgcctggatatctagacatttccatatatcctctgaaatctaggtagaagttcccaaagctcagttcttgacttctgtgtacccacaggctcaacaccacatggaagctgccaaatcttggggcttgcaccctctgtagccatgggctgagctctatcttggctccttttagccatggctggagtggctgggatgcagggcacctagtccctaggctgcacatagcaggggggctctgggcccggcccaggaaaccattttgccttcctaggcctctggtcctatgatgggaggggctgccatgaaaacttctggcatttcctggagacaattttcccattgccttggtgattaacatttggctcctcgttacatatgcaaatttctgtagtcagattgaatttctcctcagaaaatgagtttttcttttctattgcatcttcaggctgcaaattttctgaacttttatgctctgcttcccttttaaacataatttccaattccaaaccatatctttgtggatacataaaactgaatgcttttaacagcacccaagtcaaatcttgaacactttgctgtttagaaattccttccaccagatgccctaaatcatctctctcatgttcaaaattccacagatctctcggacaggggcaaaaagccaccagtctctttgctaaagcgtagcaaaagtgacctttactacagttaccaagaagtttctcatctccctctgagaccacctcagtctggactttattgtccatatcactatcagcatttgggtcaaagccattcaacaagtctctaggaagttccaaactttcccacatcttcctgtcttctgacccctccaattctctaggaagttccagagtttcccatactttcctgtcttcttctgagtcctcccaactgtttcaacctctgcctgttacccagttccaaagttgcttccacatttttgggtttctttatagcagtatcccactctctgtggtaccaatttactgtattagtctgttctcatgctgctataaagaactacctgagactgggtaatttataaaggaacgaggtttaattgactcactggtttgcatggctggggaggcctcaggaaacttacaatcactgtggaagcagaagcaaacacatcctttgtcacatgatggcaagaaggagaagtgccgagcaaaggaggaaaagccccttatgaaaccatcagctctcatgagagctcactatcataagaacagcagcacgggagtgaccaccccccatgattcagttacctcccactggatccctcccatgacatctggggattatgggaactgcaattcaagacgggatttgggtggggacacagccaaaccctatcactgcctttaagatctatgaattgtttttctacattgaagaaatttgtagacatttgttttttattctctttttggtttgctgagagcagtagtctcttggaagtgagtttcatttacattttttcctttgggtgtcaaatatataaaatattttttaaaatcaatggctgagggataaatgagggttggtagaaagggaaaggataagggttgtagttaacggaccatgttttaatgtgtctataattagatggaagttgtctcttaccattcaacatcctggatggccttcctatagaggacattttcatcttcttttgtcgtccagagctagcatatgtgtttcatgtctttagatagtgaaaatcaattcagattttcatggaaaatgctctctcttcatcctaaagacagaattgtcacggctatttcgtttattgaaaagtgaaacctgctacagttagcatatagttaattccatatatgttacctgtatcatttaatacattcacaaagtaaaaaaccaaattttgccaagttcttgatagtaacaatagtaaaatggaatttctgttggcatattttcatgttattctgaaatgctgaatggatttattaagattgataacaatatgttgtacctttatgttctaaaatttaataacagttattcttccaaacatgccagcgtcctcaatagttgacagtctgcaaaatattctattatgcaatcagccatatctccttcttgagctttctttaagtacttgtatcctgtatttttccctgaaatctagcagtaagttgaagaaatgataaacaaaattgtatcattgtatataatggctatttataaatactgatgtacattttcataatgttatttaaatgattacttcagatatgtatttctgttttctacattttaacttctcaacatattaggttgttatcttagattggattttctaagacatagactctaagacagagatttccatgcagatggtttcttagtgagtgcttttaagaaaaatgcctgggagggagtaaaggcagcaggattgaggagagagaggagttgaatgatgatgcagtgaaatggaagatcttatctggtcccatgtggggttgggatgaccatttagagtattaccgtatgaagcaaggaaggtggaccattgtatccctaatccattagtcattagatgtgagcctcccaactaccagcttccgggcaatatcatcttggtcaaagaagtgcctgtctgctgagagaaatttcttggaagagcttaggtatgatctgttagtagataacaatcccagcaactgggagaatgaatgcttcatttgtaattggtgaatctcggtggcacaccacagtgttcgctacggtaatctttatacttattgagacatatattgtttttaagtaaaacttgtatacctagtaatgcatttaggtagtgtattggccaagctagtcctttttggaaacaatttcattgtggtataaatgatatacaataagctacacatttaaatagtacaatttgataagttttgacatatgcaaataccagtgaaactattagcacagtcaagataataaacatatccaatatcctcacaagtctgttttcggtaatcactctctcctgcccctcccttgattcccaggttaccactgatgctgactggcattatagataagtttgcgttttatagaattttataaaagtagaatcatgaagtatgtaccttatttctggtctgccttctttcactcacaaactactaactttcattttgtgaataatatgatctccgtgtgattacacacattaagaaagtcaataaaaacattgtaatttgattccgatactagtttatgggtctacattatgtatttaaagatactatcatgtttggattagcccttaggtatcaagtaaccctggagttgaggcagttactgttttatttgctatcaatctttttataagctcaccttccactaattacccaaaaatatttgatttaatacctgagtacagaaaaagaacatattcacaatgtttaaattttataatttaatattataatttacaacagtttaaaataactagtcctgaaattgagtatttctcacctaatattctgctctatttattacccactccacgaaaaaatttcccagaaaaatcacaaacatgtctcttgagtgtattattacccaacccacagaagaatttccaaaaacagtcgcaaacattctctcttgagtgcaaccattttctcgggccagccattcattgaaacaaaatagcctgtataacttctgtgggtagacatttgtaggttgttcttttgaggcattagtgctattgcatttaagataaagaaataacgaattcacaaattttataaagttctcttaaatttaccaagtcaatagcaccaccactttgattcctataacctgtgacttagttaggcttctcaattccaagaacataccaccattatttcttataatgtcctcagattaaaacatgtgttgtcctttctttatacctccctgcactttaattgaatattttgccatttactggattctgtacactttttatgttttcatgccctcccttttcattctcctggacatcaatcgcaagtcagtagataccttgtaagagatctctctccacccaaatcactgtttcttttgaaagagttaacctttctgaagcagcactcctgcttcacatttcccagcacaggaaccttcagtgtttctctgttgatagctttgatttcaaacgggtagccccaggagaaaagagagctgaaggatatgttttgcttggctgctttgtttgacctgcaaggaacattaaaaggcaatgaaaccgggcagagactggactgatcaacaccatcagtttagcacttattgctatactttctaaggctttacaattttatgtgtcccacgtgtcccctgaaggcatttgattttctaacctcctaggccagaggctaacatccagaattcatagtctggcacttataaaccctaacttagcttctgtcacttgtatctctatgcaactctacagcaaaatgtacttattttctctaaaatacccttattccatacttctttggagtgtaattttatatataaaagtcctcaccacctgtaaacattaggaagctttgattcgaagaagcagaagccatctccatttaactgaagtgaaatgaaacttactggagggataatgtatagttcttggaaatgaaggaaaagaaggcaactgtggcagagggagggcagcactgagagtcaggaactccagggaagttactttttggatgctgtcattaaaatgcttcagcttcaaattgtactgactctacctttctcaattctagattcaaatttctaaatgtaattggcataaattaggaacttgtcccaccagtttatagagtttacagagcactatgattataggtccccctaagatcatgcagaatgagggaagagtaatttcatccaaggaaaagcagggtaccattcaccaaagagtggagatacttattcagaacaattaatgttagatgccacaaaaaaactaaccctgaaatcaaagtggcctaatgaatgcttatttattgctcatataaagtctgatataaatcaggtagcattccttcacagtgactcagggacctaaattgctttcatcttgtggctctgccatgtcaacattgaaacttcagaggtattgacaaaggagagctgagaaattgacactaactatcaagtacctcaggcaagaagtgatgcatcacttcctacactttcccactttccaggattcaatcacaattgcactcacgaaacctcaagggaacatgagaaacataatgaaatcaataccaagatatccaaagagtactaattttcttcaccacagaagggatattggacagacaaaaaattttgggacagaggaatatccactaaatgatccttccatgccctgctcagatgctacattttccattaaggctctcttgaccaacccataaggagatgatctccaactcctctgaacatctggaacattgcattctacttatttttactgtctcctattgtaataattgttggctattccttattagacaaattataagcttttatgggacggtgatcaaaagtcctaatttatcttgtcttcctacagcattcaaagcattgtagaccttcaatacatagcagtcttcgaagccagagtattagtattttttctaaaactgtattcatcgcaacgaactcgatggatgttcaataaaaatgtattgaatagtcattcatgcagatagcaaatttcttaaaacatttcttactcaatgtttacttatattcatcatgaatataaatttaatataataatatcaaatcccattacatttagtacaaagtaaatataccaataattttatatatgtttaagtgaatttttatatttcatattatttgtgaatgatacacatcgtcgtggaaaatttacaacgttgaagtaaattatacaatatagggtatttgtattaaaatacatttcatagaaggtgctttaaatttaaaaagttagcatgaatacatattaaatgtaaaagagtctttaaaatgaaaaatatttcacacttgtgggtttgatctaaaaatatcagtcgctatatgatatggctagacagatttgagtaggtataattttaatgaataatattgtgtgatattttagggtccaaaattgaatgtttctattaagtaacagatatttaaatgccaagcagaagctacactggcaaaacaagatttagtatgttatcttaagtgtatcctaaatcctctttcatcttatggagaagaaatacatgcttttagtttccagccactcctgtctatattcatttaaaataaactattatttatatcagatatgatgccatgtgagtccacaatttgtagtatagagaaataatttcattgaattattttggctgtttgtacctgagacctgattctgaatcatttatttttctatttaagttgtgctattttatgatcctacctatggctatgttcaaaacaatgacaaaatatattttaccctgatctttttttcattattatactttaagttctgggacacacgtgcagaacgggcaggtttgttgcataggtgtacacgttccatggtggtttgctgcacacatcaacccatcatctacattaggtatttctcctaatgctatccctcccctaaccccccatcccctgagaggccccggtgtgtgatgttccccgccctgtgtctatgtgttctcatcgttcaactcccacttatgggtgagaatatgtggtgtttggttttctgttcctgtgttagtttgctgagaatgatggtttccagcttcatccatgtccgtgcaaaggacatgaactcattcttttttatggctgcatagtattccatggtgtatatgtgccaattttctttatccagtctatcattgatgggcatttgggttggttccaagtctttgctattgtaaatagtgctgcaataaacatacgtgtgcatgtgtctttataggagaatgatttataatactttgggtatatatgcagtaatgggattgctgggtcaaatggtatttctggttctgtatccttgaggaatcgccacactgtcttccacaatggttgaactagtttacagtcccaccaacagtgtaaaagcgttcctttttctccacatcctctccagcatctgttgttgcctgacttttgaatgttcgccattctaactggtgtgagatggtatctcattgtggttttgatttgcattcctctaatgaccagtgataatgagctttttttgatatgtttgctggctgcataaatgtcttgttttgagaagtgtctgttcatatccttagcccactttctgatgggtttttttttttcttgtaaatttgtttaagttccttatagattccgggtattagccctttgtcagatgtatagattgcaaaaattttctcccaatctgtagtttgcctgttcactctcatgatagtttcttttgcagtgtagaagctctttagtttcattagatcccatttgtcaattttggcttttgttgctgttgcttttggtgttttagtcatgcagtctttccccgtacttgtgtcctgaatggtattgcctaggttttcttctagggttttgatggttttcggttttaggtttaagtctttaatgcatcttgagttgatttttgtataaggggtaaggaaggggtccagtttccgttttctgcatatgactagccagttttcccaacaccatttattaaatagggaatcctttccccgttgcttgtttttgtcaggtttgtcaaagatcagatggttgtagatgtgtggcattatttttctggcctctgttctgttccattggtctatatatctgttttgctaccagtaccagtctgttttgcttactgtagccttgtagtatagtttgaagtcaggtagcatgatgcctccagctttgttcattttacttaggattgtcttggctatacaagctcttttttggttccatctgaaatgtaaagtaatttttcctaattctgtaaagaaagtcagtggtagcctgttggggatagcattgaatctgtaaattaatttggacagtatggccattttcactccactgattcttcctaaccacgagcatgaaatgttttttccatttgtttgcgtcctttcgtattttcttgaacagtggtttgtagttctccttgaagaggtccttcacatcccttgtaagttgtattcctaggcactttattctctttgtagcaattgtgaataggagttcacccacgatttggctctctgtttgtctattcttggtgtataggaatgcttgtgatcttttcactttgattttgtattctgagacttggctgaagttgctcgtaatgttaggggcagccagagagaaaggctgggttacccacaaagggaagcccatcagactaacagtggatcactctgcagaaaccctacaagctagaagagagtgggtgccaatattcaacactcttcaataagggaattttcaacccagaatttcatatccagccaaactaagtttcataagcaaaggagaaataaaatcctttacagacaagcaaatgctgagtgattttgtcaccaccaggcctggcttacaagagctcctgaaggaatcactaaacatggaaaggaaaaaccggtaccagccactgagagaaacataccaaattgtaaagaccatcgaccctatgaagaaactgcctcaactaacaggcaaaataactaaccaacatcataattacaggatcacattcacacatgacaatattaactttaaatgtaaatgggctaaatgccccaattaaaagacacagactggcaaattggataaagagtcaggaccatcagtgtggtgtattcaggagacccatctcacatgcaaacacacacataggctcaaagcaaagggatggcggaatattttccaagcaaatggaaagcaaaaaaataaaaaattaaaaaaaataaaaaaaaaaacaggggttacaatcctagtctctgataaaacagactttaaaccaacaaagatcaagaaagacaaagaagggtattacattacataatggtaaagggagcaacgcaacaagaagaactaactattctaaatatatatgcacccaatacaggagcacccagattcgtaaagcaagttcctagagacctacaaagagacttacactcctacacagtaatagtgagagacttttatactccactgtcaatattagattaacgagacagaaaattaccctgatctttaacattccaggcaagtatgttttcagtcatacatagtacgtgaatctgttatattttaaatccaagcttttggaggacaaatgatttcacagttatacaactcagcctctcccagactcaagtctctcacttgatgcagtattcccaccccatcttcaataaaagaagaaagcatgaaacatcgcattgatatagggaaagtatatctgagttttctatatagcatataaagaagtaaaataactctgtgatttgtgatgagatagatttagctgcaacaatgaggtctggatattaatattggattaacttcctttgagattgcaacttccatgtggcattcagcactttccttgttttctcatatgtaggccgagaataaaattatcctgtttctatttcccaacatgaaaggtcttttaactgtttgaagacatatgtttcatgtgaaaccaaggaattgctactgcaattttgtaagacagaagttagcaaacttattctgtaaggaacaagatagtaaatattataggctttgcgggccatatggtctatctcacaactattaaactctgccatttttttttttttttgcaaaagcaaccatagacaatatgtaaatgaatgagtgtgattatattccaataaaactttatttttaaactacaagactagttcttaaaataaaatttaacaaagaactattatatgatccaataattccacttctgggtatatacccaaaataattgaaaacaggtattcacacagatatttgtacacccaagttcatagcagcatattttactgtagagaaaaggtagaaacaaatgtacactgtgtacactgaccaagaatggagaaacaaaacgtggtgtatccatacagcagaacagtattctgctttaaaaaggaatgaaattctgtcacatcctaaaatagggatgaactttggagatattccacctagagtagttaaattcttagacaaatagttgcatggttgccagggaccagggaggggtaggggaaatgagcagttcttgtgtcattggtatagagtttcagtttagaaagatgaagagttttggagatagatggtggtgatgtttacatatccatgtgaatgtatctaatgccactgaactgtatacacttacaatggttgaaatattttgtatattttcccacagttaaaaaagacaagcccatgtgcccaaattgctgatataaatctgtattcctattagtgagcagtaatgagccatgtttagtgcagctgatatggttaagatggaacaattgcatgtaatgcaatggtgggtaacatctaataaaaattggtactcaccaatttccatttccattgtggatataaacacccttcacattatgaatcatgttatttgttatttgtgtacttacttattaaatcacttttctccatctctctcacctctatgactctgtacatgtacaaacaacatacacactgtgaacttctttagaatgacagttacattttcgttacttgattcattgtttggccaagtagatacccagtaagcataactagcaagtgaataatgtatatgtgatcattttccttttcaaaaaccacttcttatctctaccacaccaccacacattattatatgctacacttcttatataaaacaaaaaagaataggccaggtgtggtggctctcgcctgtaatcccagcaatttgagaggccgaggtgggcagatcacttgaggccaggagttagagtccagcccagccaacatggtgaaaccccatctctgctaaaaatacaaaaattggccaggcgtgttggcgcatgcttgtaatcccagctacttgggaggctgaggcaggagaatcactggaacccaggaggcggaggttgcagtgagctaagatcatgccactgccctccagcctgggcaacagagcaagactctgtctcaaaaacaaacaaagaataaataagctttaataaactcttttgcagaagagttttcatttttaaacatagaggaaaaagaagatgaggatgaacgatagtgatgcccagaagagaaaattgtgtaagacaaaatcaattgaccaggcgtggtggctcacgcctgtaatcgcagcactttgggaggctgagacgggcagattatgaggtcaggagttcgaaaacagcctagccaatatggtgaaaccctgtctctactaaaaatacaaaaattagccgggcttggtggtgcacgcctatagtcccagctacttgggaggctgaggcagaagaatctcctgaacccagcaggcggaggttgcagtgagccaagatcacgccactgcactccagcctgggtgacagagcgagactacatctcaaaaaaaaaaaaaaaagattaaatcaattttagattgatatagagataaataattccctaagtacaattaaagcaaggatcagaccctgatgagtaaggatgatctaacaaagggctgacaatataaagtgaatgcgattgtcaccaaataaacatctcccaagagctttgggacaatcttcagctaagcatattctgcactttacatcgttctgccatatgccctatgtagcttttcatcctccagaaatttgaatagcacacagtattttttggcaccgagtaattgtggaacttaaacttcctacaaagagagaagctgtttcagtcagctaagtgaccagttagtaagcaacttctattctcttagtgtcgatagggttaaagacagtcataagctccccaaacccttggccgcctcaattttttcatttaaatacttatcttcttatcttcatctattttttagagtcacacataaactctgtctatgaggttcttaaagacctggacaatatatttaatctctgtatccttaaatctcaccatgatatctcaaagatggtagataaaactgttttccctcacttctctgactccataccaatacttaatcgatcgggaaagttttataaaccatttaccgttgaatataaatatatatacacacacaaacatatatatatttatatatatttatgtatatatatatttatatatctatatatatttatgtatatatttatatatatttatatatatttttatatatttatatatttatatatatttatatatttatatatatttatatatatttatatacttatatatatttatatatatatttatatatatttatatatatttatatatatttatatatttatatatatttatatatatatttatatatttatatatatttatatatttatatatatttatatatatatttatatatttatatatatatatttatatatttgtatttatatatatttatatatacacatatttatatatttatttatatatgtttatatatatatatatatggcactatatatcagtgagcaaaggcatcataatctttatttttatttctgtattcatttattcaacatatagtaattctgatcctgtctcaaaaactctacagaaattaacaaagaacacattgtttctgcctttttggagctgaatgtttagtgggggaaaatgtattttaaggcaataatcatatacatgagtgtatatttacaagccgcagtaggtgctatgaatgaaaagtataaggagctatgagatattctaacaaaaagaaatgctgcagtctagagactgagagtaattatctgtgaggaaaagtattgaagcagagacctgcaactcagtaaagagtgtagggagtcacatgaacaaagtcttgagatgttggtagagatcttggaatgttcgaaattctaaaagaaagcccttgtgtatggggtatggtgagagagggagagcgtggcaagttttacgttgtacaagtcattgtaggccacaaaaataagtatagattttatctaagtgcaacggaaaaccattacaagtttattttttgattcttaaattttgttttacttatttatttatttcaagacacaatctcactctgttgcccaggctggagtgcagtgacatgatcacggctcactgcagccttgaactccttgggctcaagcaatcctcccatatcaccctcctacctcagcttcctgggtagctgggactactacaggcatttgccactatgcctggctaactttaaacaattattttgaagagacagggtcttgttacgtttctaagtttctaaggctgatcttggattactgggcccaagcaatcctcccgcctcatcctcttaaaatggtgggattacagatatgagccacctcacccagcaaggtagtgacataatcattgtttttgctgaaaacaatgtactttagggaacctccctgaaaacagaatggccacttagaataccaaagcatagaccaagccttgagatggcaatggaagtggaaataaacatgtctttgatacttatgttaatggagctattagtagcaacttttgacagatttgaaagtggagttgaaagacagtgaagtgtcagggatgatccctgagcatattagataatattgagctggagaacagaaaagaaggggcagatttggaggtggagacctttctagatttatattcaatttgagatacatctgaaacatctacatgaaacgtggatgaaatatctgtgaccaagatacatacgtgggatacctaggcatgtaaataatatttaaagttatgtgagtgggtgcaataacctaaagagagactgtaggtagaagattgatcaggacaaatctttgaggaacttttttttttaattattattatactttacgttctgggatacaggtgcagaacgtgcaggtttgttacataggtatacacgtgctatggtggtttgctgcacccatcaacccgtcatctacattaggtatttctcctaatgctatccctaccctagccccccacccccaacaggcaccagtgtgtgttgttcccctccctgtgtccatgtgttctcactgttccactcccacttacgagtgagtccatgcagtgtttcattttctgttcctgtgttagtttgctaagaatgatggtttccagcttcatccatgtccctgcaaaggacatgaagtcatcctgttttatgaggtacttttaatgcatttagtgactgggtaaggaataaccctgaaaaggagcacaaaaaccatcgaggtatgaagaaagccaggagatgtagtttcacaaagcagccagtggacagtaatggacaccagcataagcttaagacagcagtgatagtgttcatcagtgctgaaaactcattggaagtggctgaccatatgttgattgcgaatgcaatgccttctcccatctcctattgcttttcactgtttccgtcatgtccagagtgaaaacactggggaggcagaactgtgtaccaagaaaaatgttttgtgtcagaggaaacaagagctcattaatttccttttgacccgcatggataggaatacgataagcaggagaaaaataaaacctgctaaactaggcaaataaagcttaatagaaaagagagaaaatattgcttacaaagggaagaagacatttgccacaatattagctaaaaagagagtgaggaaaatccacatttaccatttttattatgtgtttccaaagtcgacattaagtgaatattatcactttgaagacagagaatagattgtaagcagaagaggaagtgggattttttaaatggcatatatttaaatgttgaaaaacccatttccaatactcccactgagatatatgcaataaaaacactccgcaatcagtaatatacatgtgaagctcctaaaaatcctccattgagaagattctataaaactataaagtattattatttctgctatcagaaaataaacacatactttctaagaacaagatgaagaccttaattcatcttcccaggaatatacttgtgtacttaatggttcaaggcgtttgtgatgcaaaaaaagtgggacattatgtacaaaatagttttaatcagaaaatgaaggaagtttggtatggtatggttctagggttgcaagttttcctgcaaaaagggagtacttatggctaggtgatgcagccaaggaagcatctctgaggacaggttatcctggctcctattccaaaatatttaggtctccttgagtgttcgatccttgaaccaaggacaagaatagaaagaaataaaagccacttgtataaaggttgccttcattttgtgtcgaatattgacaggagaaagccagatttgtagcttttccagggataagtgagtctcagacacagttaagagcttggctttggaattagattgacctgagtttgaatcgtggctccatcaatctctgattgtgtgaatttttggcaagttttagctgaacctcaattttctcataagtaaaataggcataatacagctatgattctgacccttgccattagcactctgagctacttgtcagtgtatcctggtctcttcctcaagcacttttccactttgttatttcaagattctttgaaattatgaacagtagctcttgatcaccaaacaaatgggagaccatagattcaaaggaacattttagtaggatatttgataagctttgtatttttttgtgctttgaaaattagagtagatttagatttaaggaactataaagctatatgtttacaaaactttattcagttgggcagttctgactcagtaactgaaataaaattgatgaaaacaaaacatatgttttactgttgtgttcacatttaaagattatttaatgcataaccaaaataggttcagcaaatgtttatacatacatgtacttagatatttgtaattcttatggtagagcatgggaatgaatgagaattctcctaggctggaataaaactaatgtctaactaagaattggcctttcacttcacgaatatatatcattatatataaaagattcatcctttgttaacttatttgtttagcttagtactttctaagtacttttctatcctgtcttggtccctatataagaatgatactattataaaaatgaacatcctattatttcataatgattagcatatcagcatatttaagagcaatgcctatatctttaccttcattattattttcatgtttaaaatcctgataattctagaaaaacaaggttgtaattatccattcataataaaagtcacaccaagttattcttgataattaacttggcatagtggagtgcactgagcaattaataattaattacgtggttactagctcaaattttattgagaaccaaggagttaaaattaatagtattgtgtttgcaatgagttaattactttgtttctttgtttttttttttggaatagtgccataattagtatcctaatagaaacagaatataaagtgggtttctgagtgcttgcttgtcgaggtgtgtaacaacatatattttaattataatttgagtcactaattgttgtcaaatacaattttaatttcttagttcagagattaaaagatatgtaaacagctccaaaaaagaatatgataagatggtttatacaagtaaataaataactatatgacttcagaagttttatttaacaacagttgtataagtgttttaactaatgttaacaatgccttttttgtaaatctcctctaccacaaatatgagataaatttaagaacggcattttcattaaatattgattattaaaattcatatataagtattggctgtacctgagcatttacagtgaaaccatgaaggactggcaggtttggggctgtttgataatatccttccttaatctttcttcgtagcatcattgtttaattttggctgaccacaatcacttatgaaaagaaacagctcaaataattagtataacctctttctcttcataaaaccttcaaatcaatgtggtcataattatgaaagtgtaagattataaaatcttctcatttaaatatacatcttcatattagcagacttggctaatttcttcatttatccttgacatccacacttaaactctgtcaaactggtcattcatagactcattattcattcaacaaagattagtgtgaccctactatgattctgagggctagaaatataaaactgaataacatataaaccctgatttctgtatttatatatacagaaaggaattatgaactcacagttttaatgcacagtgacgagtcctcagttcatgtctgccttgggagctaggcatataccaaagcaggactgtctaacacagtttgggggtctcagtctggaaggatccgggtgagatgatccttgaattgagttctaaaaaatgaggagaaattatccagataatggaaagtttaggagaaattaaccagataatggaaagtttaggaaagaaacactatttatatgtcaaggacaaagtttgaccaaatgtgtctctgaatctaactggctttatgtaagataaaattaaaaaataattgtcactaaggtttttcacatctgcagcaactaccatcatatctggctcaatatttaaaagaaatacttaacgatttttggcatttattgctactataatagattgtgctatttaaagagaaattctagatacatgccaaagtattttcaggtgaagtaatgtgattcgtgggttttgttttgacaaacttccaaggaaattatttttaatataaagagcaatggaggaagattaaacaagattcgcaaatgttgataattgctcaaggtggtgacaggtgcatgggggtccataatatactgttctctttacttatatatgtctttgaagattttcatgatgtaaaattttaaaatcagaattacagtaatacctctttctttgacaatcgttttcaaacttggttcaacaactgaatttaaattacctacatggctataaaaataaattagatatcctggttatttggtctggggtgggtcctggccatatctgtagggtgtgtgggtgtgtgtgcatttagcttcacatttgactctgaagtacgtggaaaaccaattctgggctctacatatgcaattccaatgcctgacattaggtggtgctggttgtgagccatgatttcaggtttgacttgtagagttaacagaagtgatatcaccaccgatcccacagaaatacaaactaccgtcagagaatactacaaacacctctacacaaataaactagaaaatctagaagaaatggatacattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcataccgaatccagcagcacatcaaaaagcttatccaccatgatcaagtgggcttcatccttgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaaaggtattcagttaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtgatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcacactagctgacttcaaactatactacaaggctacagtaaccaaaacagcatggtactggtaccaaaacagagatatagatcaatggaacagaacagagccctcagaaataacgccacatacctacaactatctgatctttgacaaacctgaggaaaacaagcaatggggaaaggattccctatttaataaatggtgctgggaagactggctagccatatgtagaaagctgaaactggatcccttccttacaccttatacaaaaatcaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacagggaacctacaacatgggagaaaattttcgcaacctactcatctgacaaagggctaatatccagaatctacaatgaactcaaacaaatttacaagaaaaaaacaaacaaccccatcaaaaagtgagcgaaggacatgaacagacacttctcaaaagaagacatttatgcagccaaaaaacacatgaaaaaatcctcaccatcactggccatcagagtaatgcaaatcaaaaccactatgagatatcatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaataacaaagacttggaaccaacccaaatgtccaacaatgatagactggattaagaaaatgtggcacatatacaccatggaatactatgcagccagaaaaaatgatgagttcatgtcctttgtagggacatggatgaaactggaaaccgtcattctcagtaaactatcgcaagaacaaaaaaccaaacactgcatattctcactcataggtggggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctacacaatgtgcacatgtaccctaaaacttaaagtataataaaaaaaaaaaagttcgttcctcttgttagaattttcatacaaatgcaagactccttattttcaaagagaaaacaaaattttatataaactaatacctgagaagaataggaaaaattaatgatgtatgggataggtactgataagaacctcttcttttgtgtacattgtgataaactaatgtttaacttgagtcgatgtgctggaaatacttgttaaattttcaagaattttgagatctgttaaacacaaccattatcaaaaattaaattatggtaacttacattaaatgaaatatattgttcacaaatgtactagatgcacaaaagtcatcactacctaattcttttattatatttcactattatctacgggtttgttacctgtataatggaatgactgtataatggtgtagtgctaacttcatgtttggtgacattataatgatagcttaaaattaaacatactgggaatattcaaatatgtccttcctctcaggggatctgattgttagacatttaccagcatagcactgtcttaattaacatcatataattgtcttttatccttaagatgttgagccagtaaatatcacaggagagtttgttccttaggttttaatacttgctttaccagtttactgtagcatcatgtgaaaccagcttctagaccagctgtctttaattggtatgtacccaagctaatccttgtcaggctatcatcaacccaagcacttttgaagttatttttattattacgctacagaaagattttatggcctttttgctcttttctttaccctagccctaggatcatataatttcatctcctatttattcctatttatttccttatctaaaatcttacttaactagcttgcttgcctgcctgtctgcctgtctgcctgcttgcttggtttttctttttttctttcttttctttacttctgctttcctttcctttcttttgtttcttccttccttccttccttcttcctttcctttccttctgttccttttccttttccttttcctttgcgttcctttgctttccttgctttcttcgcttgctttcttttcagtaccacaaaaaaactaacaataacaaaaatattgctacaaaaattgtgacctcccaattctatcctcatttcacggacccataaaatgattatatatctatgccaatgcgttctaactacatgatattattattgatgataagagaatccaaccctcaagaaatgaagtattataatgttttagaacacacagaagcatttttaaccaaaatgttccatgtgattttatagggtgcatgttttaccttttcttatttggaaaagtagcaaaagtattaacaaataaaataagttacatactctttgtatataaatctttcgtgtacataataatgccatttcccttctagtgcttccattattgaaaaaaaatagacatatagcaacgtgctagacattgaagttaactgttaaaaagtcatcagagggtaatgttaaaggtggtatttcaggtaataaagcatatgcagaatgattctattggctttatttccaacatgagtgttattagtaccaaggacactgaagtttaaaggaggggagtgatgagactgatcattactttgtcttctgtaacaggacttaggtggcccagagtgatccttgttggttgattggttagttgaacttctatttttgttactaggcctgcagatctgtggaatctccagagtgctgtgtaatgttacataggccacacaccagacactgttccctgaaggactgaaggtggaattggaacaatatgtagacagttcttgttgcagttaccaaggaaatttggttaggattcaggcctccatgtcagaaaaggaagtctattttatgtgctagaaaaataaccctaatcatcttatcttgggtctctctggggagcatgatgatctacctggtcttgtaaactgtatagaaccggctgggttgagacacatatgtctcataacagagcttccacttaaggctataaaatagtggtccctctattgggtatatgccttatggaaaaatatacgttatgctggtacctattataaaaaccaatgcaaaatgattagagatttctaatccaagtgttatcctcatctgctcccaaaatacagcaatgaaaaaatagaaaataaaaaaggatatatttacagaactgtatttacagaaatatatgttgatgacaagataatcaaatacatatcaaatcatgatgtgtatttacagaaatatatttacagaaatgtaaagcagagaatggggcggaagtccctgacagacttgacactgaaccacaaaacaacagtggaagccaggaatttggatgctgcgggatagttgggattaaaattgcttcaagcaaggtgtggaactggagacaaactcagtattcaaaaccagaggctgggctgtggtgcttgcattcgtgaaagaaaacctggggaaaaagtgcttcttcaggctgtagcctgacgctatggcttgcctaaacttatgggcctatgtaggtgtaagaataaagacatagccttgctgctgggaactgtgttgcatctgttctcttgcttgatgaatggattgaaattatccccagtaacattgcagtgcaagaactttaaaccttaaaggggtggctggagaccacgggacgcgatgcacatgcaactactaaatgctagatgaggatacctgaggagagagaacaagacacaaacgtgaacatggacctccaatagaaatgacaatcgaaaacatacatttatcttctctctctcccaaattgttcaaagattacgctaagggaataaaaacaatacagtcataaaatgacaaataaaatggaagaagagacatctgcacagacatatcaagtcaatgagatgaaaattaggacaagtaagccaatttgtttttcaggatcccagaaaaacttgtggattgaagacgctaggtgttttagaaggccatatattcccgagaggggctggaaataaaggggttgttttgaatcccttaaaaggggcaattacatttcatgtccccagctcagggtagttaattagacactactcctctctcatcccagcagacgtgagtgagtggtttgctttctggtgaggctgaaacaacttttggcatttggacaacaggattagttgatggaagagagagccaccatactgaaaatacaggattaagttaaagtcaacatatttaatggtgagaccagcagtccctcttcaccttcttggctcttaagtttctatcctctgggcagtagattataaatttattctcctgagagcctacctgcaatacgaaaactatttttagtcaagttttattgctataacaaaataccatagactggatgccttataaacaacagacctttatttctcaccgttctggaggctgggaagttcaagatcaaggcactggcaggtttggtgtctggtgaaagctcatttcctgtcttctcactgtaacctcacaaggcagcaggtccaagggaactgtcttgggcctcttttgtaagggtactattctcattctggatggctttggccttatgacctaattaccttccaaaggccccacttcctaatgtcatcaccttgagggtgaggatttcaacgtataaattttgcaagaacacactcagatcatagtaacctacaattaatgatatgtaatgatccaccagtgaaatagccagatctgtgcctaatgaccatatattgaagcccaccaagtataagccctacatacgcacaaggaatttccaaaagcatttaatgcctcagttttaagagacaatcaaggatttccagatatttgaacatgtctcaaagatggaagacagaaaccaacataaaaacaaaaagcagaaatattgggaaaaaaacaatagccacataaatgaaacagaaatctctgcagaaagagagacaaggcatagaccttaagaaaactttttaaagatagctataaaattattatctcacagtgagactagtcactgtattcataagaaagaacaagagactatagaaggtggtatttccgagaaagataagggttatttaaattaatagtatagcaggttaagtttttaaattcttaattgtataaatttatgggttaccagtgtaattttgttatatgaatatattttatagtggtgaaggcagagcttttagtatatccaccactggaataacatacatggtatgcatagcagttttagagcaatgaaactactctgtgtgatactataatggtggatacctttcattatatatttgtccaaacccatagaagatacaacatcacaagcaaactctaatgtaaactatggacttcgagtgttaatgatatatcaatgtatgtaagtcagttataacaaatgtaccactctggtgtgggatgttgatagcggggtaggctgtgtgtaatgaggaagggggccagagagtatacgggaaatctctgtactttcccctcgattttgctataaatgtaaaattgctttaaaaaatcaagtctattaaaaatgaagagcagaaataaaagttcaaaagtagaagataaatttgaagaaatatctcataaagcagtataaatagccaaaagcatggaaaatgggagagtataagaatcttagaagatcattctaggtaagtgtttcacaaatagaggtgattttgtcctgcagaggacgtttgacaatgtacggagacctttttcgttgtcacaaataaggaaaggatgtactactggcctcttgtgaagagtgacgcaagaggaatgcaccatgcagccatccacaaccaagaattactcatttcaaagtgtcaatagtgtttatgtttagaaaccttgttctatgtaatccaacattcaaataatagatgttaaaaataaaacagaagagaggcaactgtggagagaaaattatcaaagaagtgacaacatcagttttcttagaactgaagaaaatgagtgtccaggtttaaagggcttactaaatgcccagcacagcaaatgagctaaaaatctacaccaaggctcatcatcataaatttttacaaaaacaaggacaaagagaagttcacagatcagaaatcagaatggctttggacttttcagcaatagccatggaaaatagcagaaaggaacacttcctttaaacttctaggaataattaactttggctttgatttcatatcctatatgaaattatgttcacaaattctgtgatgctcttctattcaagagttacagctaaatgtccctgtcattgagtgtggactagattcagtgactcttttgtgatgatatgtcatttccaagtgtaggttgtagaaagactgtggtttatgtcttgtgttctccatccacgcctatctctctctgtgtctctctttctctctctctctctctctctctctctctcatgcattgcttcttctgtgggaacacatgtcatgagcagccctatggagatgcacgtatgctgagaaactaaggcctcctgcaaagagccacaagaatgagcttagaagtgcatcatttaacaccagacaaatctcgagaggctgcaagcatagacaacagcttaactacaacctcataaaataagctatgccagtcccaccctgctaagccactctcagattcttgaccttcagaaactgccaaataataaacatttttgtttttaagctgctaaattttggaatgacttgttattcaacaatatataaattgtacaccctgataaactataaattgtgcggagaaaataattttcagagatagccttatgtactcccctaaaccttttttccccagaaatctattttcaaaaatatactctaccaagtgaagaaagaaaccaagaaagacaaagaatgtttagttgtgattggagatcagaaggagagtgttttaggcatgattcgccttgttatgctgcaataataagcaattccaaaatattagtggctagaaacacaaaggttgattttgtatctttgcaacatatccaacacaagtcagtcaagggttctgatcattgtagtcactcaggaatctaagctgattcagtctctagtattctatcattctaccgtaacaataagaagctttagcgttcaccatgtcagtcaaaaatgcgtggaaaattttaaactgactcttacatgcctctatgtaggagtgatatatgtcattttcatttcacttcatcatccaaaggaagtcacgtggtcatgcctaactctgaggggacaggggattataatcactaatatttttaagagaggtaagagaattaggaaaatattggagcattagtattacctgcaaagcctaggatccggaaaacagagaacccaacgtgggaggaagatgcaaagtggtgccagaaagatggtggaggagatcctgtaacaacagctgtataacagttgtagagagaaacctgtacagattggagaagaaaatagtgctccaggaattttgttaccaagaaaaaaaaaatctaatgtattcgaatgtattgagaggtggtattcttattgtgtaagagtataatatatgacatgtatgacagacagaagtaccatttaaaattttattaaacataagaattagatccctatctcacactgtacataaacataaaaatggtaaattgatggattgcctaaacatgaaaggcaaagcattaaaatatataaaaatattttggggcatgtagggcaaaagaggtgtcccttaagcaacagcacaaagcaaaaattgtaaagaaaaagacatatatttgatcattttaattaaaaacctgtacaatgcaaagacttcataaacaaagaaaagacataggctcagatagtatatttgcaatactaaaacaataaaggatttatgtcataatttaagaaaaatatttacctatcaatagaacaaaataaaaataacctaacaggaaaatatttttaaagtttaaaaaataatagacagttcacagaacatctgtatgtcaaatacacttatgaatagatgctaactctcatttattattggaaaaattacttcatattagtcggttttcatgctgctgataaagacatacatgagactgggtcatttatacaggaaaaaggatttaatggacttacagttccacacagctggggaggcctcacaatcttggcagaaggcaaggaggagcaagtcacatcttacatgaatggcagaaggcaaagaaagtcccctttataaaaccatcagatctcatgagactaatttactatcacgagaacagcatgggaaggacctgcccccatgattcaattacctcccacgaggtccttcccacaacatgtaggaattcaagatgagatttgggtggggacactgccaaaccatatcgtactaagtgagataacgtactcccatcggactggaacaagtaaaaaataaaataagattgtgaaaggtcacaaactctcattcttgtagaaatttaagttggtacaaccaatttagagtgtaatttagcaataatctagttaaactgaggatggcatgtcctaccaaacagcattccagttaatcacattgaagatagcatgattgttctcaggcttccatattttctgttgaacggtaagttgtcagtctaattggcattcctttaaaatagacttgtttcctcttgatgattttcacattgtaattttgtctgattttcagcacttcaccggtctttaaatgattatgtaagattttcattgctgaggaggaaatcctatcacctcaaatactatcttattagttatattttcattttattttaccatgattttaaatgaattccttaaaaaattaggttagagaactaataaatgataaagagaaaaattattcttcatcctgatagctgttatgtgagggtggaatggtatggctggtttttttcactgtcattttgtaacttggaaattcttattttttaatacaatgacaatattttcatagttaaaaaacactaaaactaaaacaatagtctgttaatgacaaatttaagggcgatttcattaagttaaaaatccatgttaaggcattataagatgaataaatactccaaatgaaaacaaagtgaaggccacttttatttaccttttgtacatgatacttatttttcaacagttgtcatgttagaaaaagttgaaaaaataaaacaagatacacccccttttggcctctaaccttccaaaattgtaatgggtagacttcaaattaaatatctaattcgactcctttccacttctaccctcatagcattagagacatttggaaaaatgaaaaaaatatagtattttatggcagggtacctcaaccccagagccacagacccgtaccaatccgttgcctgttagggacccgattcgcaaagcagtaggtgagcagcagcgggctagggaaggaagcttcatctgtatttacagctgctcctcatcactccatttctgcctgagctccacctcctgtcagatcagcagccacattaaattcccataggagcacaaaccctattgtgaactactcatgcaagggatctaggttgcatgctccttatgagaatctaatgctgcatgatctgtcactgtctcccatcaccccccagatgggaccatctagctgcaggaaaggaagctcaaggctcccactgaatctacattatggtgagttgtataattatttcattatatattataatgtgataataatataaataatgtgtgcaataactgtaatgcacttgaatcatatggaaaccatcctccaacccggtccacggaaaaattgtcttccacaaaatcagttcctggtgccaaaagggtcagggaccactgttttatgggataagtgaaagctggatttgaatccaactctaccttttacttcccatgtgaacattaaaagatgacttaatgtctctgaatctttttttccttctaagtaataactaccttgcagagttattacttgaattggccataaggtaaagaggacaccaaatacagtaaataataacataataataaagaaaccttatgaattctattcagtgatatccatattgaggtatttaaggtgaatgatactgatgtcagcagtttacctggatatgcatcaaaaatatgattgattgatggatggatcggaggaaggaaaagatatgtgatcaaaacgagtatagtaaaatgttcatggtggaatctagatatatagatatcacttgtaatttttaaaaatgttattgcatttttgaaatttgttatgttaaaatattgggtgaaaattctgatgccctggccatgtcccaaatcagttgaatcagatctctggtgtattttttttttaagatccttggatgactccattgtacagcaagtttgcaaaccactattctaacttctcaccacccccttctttatagcttacaaaattatatttttaaatgtcaaatgtcacaatttcactttccttcttcaagaactgattagacttctagcttctcctatgctctcatcttgcataacgttcatttgcacgtggttaaaactgataggcaataaataataacccatctgtcttttcctgacccaacataactaaaaccttcctttcaaggcgaaaatgaactataatctcacagacaagagtagctatagacaactaattctttctggtctctcgtggtcatgggactattcaccactgccgtccctgctgtctatttggtggaccagccagttttactgtgacccataccatggctcttgagaagcatgaagctgccgaaatcgcagttgtagggttaatggaaaacatggtgaagtatagcttacatatatatacaattttggcacaaaatgaagcctaagaaattgtaccgggctgggtgtggtgactcatgcctgtaatcccagcactttgagagaccaaggtgggcggatcacctgaggtcgggagttcgagaccagactgagcaacatggagaaaccctctctacttaaaatacaaaattagccaggcatggtggcgcatgcctgtaaccccagctactcaggaggctaaggcaagagaatctcttccaccctggaggcataggttgtggtgagagaagatcacaccattgcactccagctggggcaacaagagcgaagctccgtctcaataaataaataaataaataaataaataaataaataaataaataaataaaagaaaaagaaattgtaccaggaagtggattgggaatgctctatatattctccccctccaagaagtttttttaatttattgtattgtgaaagatctgcagctatttattttgtgtggtactcttttgcaataaactacttctgcataaatgaactcaaaaactttgatattcatgaaccttcataatgttgatctagtacatcttgcccaactagcccttgggccattccttccatgccactggttgaaaaatatgctccccaccccagtaacatcagcatcagacctctgcaaccagaaagattccataggtaatgaaatccaaatgctggcatttggaagtcaaaccagtgtattttgaaatggaaaggcaaggggaagtgcatggagcaagtacagcatgtgctacaacttcagttcataccctccttaaaatactgtgcaactaaactgtcaattgcccattgatagagatagtatctttttcagctttacaccttccgaattcaacacactgctagcctcaggactaagcgctcaataaatgtttatcaaaagattgagtaaatgaatcagtggtgaaataaaatgtacaaacacatacgcttcatacacgtttaggaagcatttctagtgagctttgtggatattttatttcttaaaggttctttttctttccatgttcatgttattctttattttttaaaatgttgcttctgcttatttctctttctacggcagctatatttacttgcctgagagcacagcatatactgatgttaatcaaactttagatgaaacacctaaaatgatagaaaagaatctgctctaattaaataataaagcaacccctacaggtttagacatgtgccttccggtgtgggaaagaaaaaatttaatgaatgtagtagttttatgccaagaacatttccctcgtgcacctgtgttttaataagatagaatataaaatagcaaaaggggcccgacttttgtgatgatatttactcataaggtagtaagtcagatgtgatgacattttctttgacttagagctgctatacttgggtcagatttcagttcagtaaatttgcagtgaagttgtctttctaacatggtgtcatcctggaactgccctgctcccacagttacatacaggctagggagtgggtaggagtgggggtgaaatcctcttaatgtttatggtgtcagtagattcaaactaaaattagccttacagccatactcctaataaggggcccctggcatatttaattgatttaacaaatttatcaaaaatagataaactgaaatctgccttgaaattaattactgtatctctatttttataagaaaatattttggacccgttccctctgccttatgggtgcaactcccggcagaataggtcatgtctcctgaaaatagttcttattttctttactacttatgacctcttatagcctagaagtttttccttgctatttctagttgaaatgctaatctggcataatttctagttgaaatgctaatctggcataatttcagaactaattttctgttaatgccacttggaacatctaaattcctcctttttcaataatactatatttgtgtgttgcaaacacacacaaatcatactatatttgtgtgtatatatagtaaattccaacttataaaagtaaaattggaatttttttctttctttggaaaattattttataattgagaattataaatgtcacttttttaaatgctgcaacctttgagattggtttcaataaagtaaaacttagtaaacattaagaaaaatgatagcttgatatgttcactaatatggtaaatgaaaacttttatgtgtgtataggctcttgttaattataactaccttcacaggaaaaacagtcttgtggaaggtaatggtgccagtgagagaaaatagagaaagtagaatagtagtaagagagaaaatagaatttcccgtttagaataaagctaagtaaaaagtgaattgtttcagttttatttatgtatttgtaagtgtggtctcatgccatatatattcaaagatagacagagatcttaatctttaattttttatggccaaagaaaatgagtcccatgtaaaagggacattttcgtaagctgatctcaagtggtgtattttgatttgccgcagcagcctatggaagaaatatcattttggctgcctaagaagaaaaatgtcatacctttctattttttattcatactccgcatatttggaattcgtattctcaccatacttttgggaagataacacgaaattgccttacttgcctcgaaatcaaaatctgccattcgttttaaaataaaatggctttttcatctcattttcctttagcagaaaaaagtaagttaaatttttttgtagctgtgttaagtgtactgttcctccctcgttgagaacgaaacaaagacatatgattccatttactgtaattgttttggtttgcccaattacaatagcagtaaaatcatttacacatagtaaaatgtttgagccttaaagggcaagaagactaaatttagctgaagatatacaactttcatgtgccaatgaggaaatgtataaaatcagttatacatattttcctcattcatagatattgaaaatattcatatatgtgtacatgtatttgataacttaatattttctaaataacagaaattatatactgtatatatatttggatattatgattattgttattgccaccattgagcacttactatgggctcagaaaacttcactgtattatttttaattcttataacaaccctgtgaaatatatattatgcctatttcacaaatgagaactctgaaatcaggaaattaaatcacttgctgaagtttacaaagcactgttaggcaataaaacagaatttcaaactcacgtttgcttgtcttcaaattttgtatgctgtacaacctgattgttttactacttgttcttaatttcaaaaaaaatcttcatactaaaagatgatactttgggagttctaaagaacatgtttttggccgggcgcggtggctcacgcctgtaatcccagcactttgggaggccgaggcagaaggatcacgaggtcaggagatcgagaccgtcctggccaacaaggtgaaaccccgtctctactaaaaaatacaaaaaattagccgggcgtggtggcgggcgcctgtagtcccagctactcgggaagctgaggcgggagaaaggcgtgaacctgggaggcagagcttgtagtgagccgagatcgcgccgctgcactccagcctggttgacagagcgagactccgtctcaaaaataacaaaacaaaacaaaacaaaacaaaaaaaaccatgtttcttttcagaaggtatactcatttgaagtggataccaattatttgtattaaaattacttatggataaatttgaatctgcaaaaattaagtgcaacattattttttggcacctgttataggaggtaaaaatggtgattcaatatagtttctacccttagggagcatttagtgtggtttagacgtaatgacactaatgtaaattagagtagaataaattctttaaagcaggacaaaaggagtgttaaagactacaaagtttcagttatggaagataaaattctggagatctattatacagcatagtgcctatagctaataatgctgtttcggacacttaaaatttcctaagaaatcttatgttgtgttcttaccaccagtaacaacaataataaaggggacaagaggaaattttgagtgatgacagatatgtttatagccttcatggtggcgatggttttgtgggtgtatacttattcccaaactctttgattttatatatatatatatatatatatatatatatatatatatatatatgatgaaactctttgagatatatatatatatatgtaaaatatgtacagctttttgtatgtcaatcatacttcattaaggtggttacaaaaaagaatcaagaaaaataatcaccctaataaaaagagtgttattaaagaggggagggattacttctaattggtagtatcagaaaggttctcatggaggaaggtatagaaaaatttaggacaatataagcaacgatactttaagaaaaggaataatataaacaaaaataaaccaaaagatgaagaaccaccaaggatgtttctgaaaaatcaagagaaattccattttgatttgagagtatgaggtacttgtcatgatatataatgagaagtgtctagaaatatgttattttgagcaaatgctgcttagaaaggaggttaggttatttattaatccattcctttgaaatataaatttcatgatcagaaacacgtgagtgtaactatccaataacaacatgatttatttccaagaggatagtatattataggagaagtaggattttttctctttcacaagctaatacagtgtttactgattcaaatgacacttaaaaaaaacaagaaacaaaaaacatacactataagctatccttattcagctatgttattgtcttgcattcctgattagaaacatacaagttagactcccaaagtctcagttttctcatttgcaaaatgaataaaatgatagtacctaccccaaggtgctgtggagtatatttaatcatgtacttaatctgaagttttaattagagtgcatagcatatatttgtggttgcttttgctcctatttctgggtaaaagttcctacacctattatatatgttttgtgtttgaatgaagagaaaggcatcattatttcaaatatcccctctagccaacaaatgaaagctaagacttggaagctaggatgtctaacaccatatcctcttcatgtggactatatagtagaggatatgtaaattaagactcaattaaatgctcacattttataaaggagacccttgaatatatcaaatcctcagagagtatgtcagtttaaacttattaagaaatttaaattatttaacttagcctgctgagtcagtttctgtagctgatttctccaaaaggtcttggtattaaaagtagcattacagatcactaatagcaaactatttctgctactttgggtatttttacagggtgctaattgtgccaaatcaagacattgaaattgcataattttaggttaatattagcataatcctacatattttttcagaagcagtgcaggaatagtacaccctgaatatttttccatcatgatggaattttcaaatatcacaacctttacattgtcagttgtctgctggaacattatattgtgtcaaagagatttataaaagagaagggcaaagaaaatttgcggagttctagacaatagtaatatcagggacacttttgctttctttgttattactaaggagttaaataatcagataccaagcataggtaaagaaatgaatctctaactatttgagtacttatcaatttatctcaaggatatttacggtgttttcccctaagccaaaatagagtgcttaattaaggtccccttagccccctaaaaatcactcaggccaagtttctgatatgtgtgtatacttatatacatattaaagtatatgtatttttgtgtgcactttcagatcaaaaagtcctcgtttatctaaagcaatttcagcttattgatgaggcttttctgttacagcgtcctcctccacagatctgcctgtctagagatttaagcccaataagagtccagcaaagtttaaacaacactttagaaatctaaagaattttaagatttattttaatagtcttagtgataacctgaattgtttgtgagttcttacaaataatgcaatcaacatttaagtaattttattatttttttgtttgtataaatttaaggtatacaagtacatttttgttacatggatatattgcagagtggcgaagtctggttttttgtgtacccatcatgcaaatgatgtaccttttctccattaagcaatttcctatccttcgcccccatcccaccctctcgcccttctgagtctccagtgtctattattccacactctgtgcgcatgtgtacacattatttagcttccacttgtaagtgagaacatgcaatatttgactttctgtttttgagttattccacttaagatgaccaccagttccatccatgttgctgcaaaagacatgatttcattctttactatggctttgtagtatttttcattgtgtatatgaaattgtttattccatacgcaatttgtgtgtgtgtacatatatatatatatatatatatatatatatatatatatatatatatatgcttagacttagaagctaggatagacacacaatggaatactacacaatggaatacattcattcacacacatataaataaaagaatatgtggagatatatctccacatattctttatccaatcatctgtttttaaataatgctattgacttctttagggtgaattttatcaatattgttttggtttaaaacactcaccttaaaagagtcacagtccctaaatgtgcatcctcatatttaaattaggtctcagtaaatttgtgcaaagtgtattctttttaggatggtgttgaacttgctaaattatttatctttaagaatcatcattttgtgtcttttattaatgaaaacaacaattatgtgattgctgatatatttggaaaatgatttctgatgtagattgatttttttattctaaattctgtgtcggtattaaaaatttatagattactaactgtattaatatcgataatactaaattttattgctatttataacttggagtgtactttcatcctcctgaaaaagctgaatgaggtaggcagtattattctgggtttatgtgtgagataactgagactcagaggtaaaatagtgtatccaagcattcatggctcttaaatggaagatataaggggtttgtgaaattactcatggacttttttattcattcattcagttattaaaatgtattcaacatttatcatgtaccaggaacagcgcttagtaccaggaattcaaaggtgcataaaacatcttccttattctaagaggtacatagtgtactggaacaaacagccttgtaaatacataattagaacatgaagtagtatgttaatagaggttttcacaaagctgtggaagcttgtcttatgaagtaactaattccaagggagagaagccttatggaatagtgacattttagatagggtgtcattctaaaatacagcaaaaggcccacagtaaaaaaggaattttggttgttatgaaaattttcagattttctatgttttcagtacagtatacatggtgggctatgtgaatgtttgtatagggaccaaagtaggaagtgaggttgtctgttagagagcgctgagaaaccgaaaatagggagagatgagttggaatatgctgaggaaaagttattaggagttttcaagaaaggccacgacagtggggctagagagaagaggctaaattaaagagtcatttctggtttagaattgataaaatatagagacaagcatgataagaaagaagtcgagaagtaaacgatggtctcaagatttctagcttggaaatcattgactaaaattaaaactaaggactggattaggccattcttgcattgctataaagaaatacctgagactgggtgtttataaagtaaagaggtttaattggctgacgattctgcaggctctacaggaagcatagcaacatctgtttctggggaggcctcagggagcttttactcatggtggaaggcagagcaggtgtaggcatttcacatggcgaaagcagagagagagagttggtggtgggggtgggtggctacctacttttaaacaaccagatcttggagaactcactcattttcatgaggacagtaccaagaggatggtattaaaccgtgagaaaccaccctgatgatccagtcacctctcaccaggccccacctccaacattggggattacaatttaatatgagatttgggtggggacacagatccaaatcatatcaaagacttgcatgggaaaataaggaattgttgacataacatctttgaggttcacatcaaatgttctgatgaggatagtccaagtagcagttggctatatacctcagataagggctgaaatttggagctatgtcataatcagcctagattaagagtcaataatctcctgcccatgggccaattacacccaccacttgtttttgtaaagtagtattgaatcccagccatatccatttgcttatgctccatgtataccttttttttgaacttcaaggcagagttgagtagttgtaacaaaaaccatacggcccacaaagcctgaaatatttgttctcaagatctttatctataaagtttgccaatacctgctgtagatgttagttgaagctttgaaagcaaatgaggtttcataaggcagtgtccatacaagacatttaacaagtttacctataaaaactagaattcctttgaggggaacacatcctagtctccattaagcacagtagaagagtcccctataatgggaaagaggtcactttaggtgttgatgttggtggtacaggtcaaagaaaatttatctttgctgtttattcagaatgcaataagtgaagttatgagaaataagggaaaaaatgtgtagaatttcaacagcgaagagaggggataaaggcatgagaatgagttcctaagctcaagtattataaacactgtgagaaacttaaaatcaaagtatgactccaaacgtatttgaagcctgagaacaaggctcacaacctagggaggattagggatcaataaaatagagtgttacaaagtataatgtcaatccagagttgtaaaaatatcagcattgaatatattgaaagcagtaaaactgaatgaggagactatcattttatatcactgtgtttatttctttgccttgttctataaatatttaaaattataaaatttttattaacagtgagagcagaactaccagagtgagcagatcaaaattgggacagatgcttttcactgcacacacttttatttttctgctgttcatgcattatcttgtacagtgcacatgttttacctaaaaaattaaaatggagtctcctgcttaggaaaaaagtatatattctgtttcaaactatatacaaaaataaaatcccaggtgactaaaaactgacatgagaaaaaaacaaattgataaagcttttacagtaaaatagaggagaatatgttaattaatatagggtaagaaaaaattgcttacacaaatgatgaagcactaatcatgaataaaaataataaagtggactaccttgtatattaataacatctatacatcaaaagacagcactgagagagtaaaaatgaaacccacagagtaggataaattatttggaatacacacataatggatgaaatgtgtgtattcataattataaagaattcctacaaatctttcagaaaagaacagataatccaatagaaaaatgggaaaagttcttgaaaagtgaaccatggcacaaaaagggcttgtggcctgctggcaatattctgtatcttgacctggatggcatttttaaggtgatcactttatagtaaataactaatgtgttttatgcatcatagtaacgttaagatttttgtcatctttacaaaataagaaatccaaacggccaataaatatataaagaatttctaagtcccattaatggtccaggccatgcaaattaaaactaaaatgaaatatcactgcttaccaaccagaatcattgaaatttataagtctgacaattccatgtggtggtgagaatatacagcaattagaaatttcacacaatgttacttggtctgtgaattgtaaatagaagtgtaaaattacactactgcttcttggagtgaaatccatttggcactatttagtaaattcaaagatctgcataacctatagcccaccaatttcacttctatatatacactctacagaaatgcatatgttcatattccaggagacatgtttgggaatgtcatagcagcatagtaatagccccaaaccaaaactacttcagtatttattaatagtaaaatttgctatagtttgaatgtgtctctttccaaattcaggtgtcgataatgtgctagtactaagaggtagggtgtttaagtggtgattaggccatgagggctccttctttgttaataaaaataagacccttataaacaaggcttcacgcagcattcagtcagcttgctctcttgcccttctaccttctgccttgtgaagatacagcaggaaggccctcaccagacaccaaatgccagagcctttatcttggacttcccagcctccagaactgtgagtgaatacattggtattatttgtaaattacccagtctcaggcattttgttataacagcacaaacagactaagacaatcatacagtgagaaattaatcaacaactaataagcaaagaggtagattaatcttgaaactatgatatagagtgttccatttggctgctggaagttttatttcttggtctgggtgatggtcaccatgggtttatatgaatggttccctatattatgtttcacaacaaaaagcatttaaaaagtaaatatatgtaatgtactcagggataggcatggccaaccatggattctatgctgaaataatgattcagatttcatcagcaggctaatgacactgcctatttaaatactttaagtcctgaaattaaagaaggtaatttctcaagaaggaatttctaatttatgggtgggtctattccccaccagagagacactagcatggctcagattctatgttggtcattttatttgcatttaaagtcttaagccaaatagaggtacactaataatgacaacaactactactactcatacttgtggaacactgccagatgctgttttaagaaatttgcattttcatttgtaactgagcttacttgaatcttctctctttttttcttggttaatctaactactggtctatcaattttacttatcttttcaaagaatcaacattttgtttcattgatcttttatatttttgtttcaatttcatttagttctgctctgatctttgttatttcttttcttctggagctttgtgttggctttgttgttgattctctagttccttcaggtgtgatgttaggtagtcagactgtgaactttcaggctctttgatgtaggcatttggtgctagaaaatttcctcttagccttgcttttgctgtatcccagaggttttgaatagattttgttgtgaatgtgatgaaaacggaacatttgtacactgctggtgattgtaaattagtacaacctacatggaaaacagtatgaagatttcttaaagaactaaaagtagatctaacatttgatctggaaatctcactaccgattatgtacctagaggaagagaattcattatatcaaaaagacacttgcacgcatatgtttatagcagcacaattcacagttgcaaagatatggaaccatcctaagtgccagccgaccaatgagtggataaagaaaatgtggcatatattttcatataccgtgaaatactattcagccacataccatgcaatactactcagccgtagaaaataatgaaataatgtcttttgcagcaactttgatggagctggatgccattattctaagtgaagtaattcaggaatggaaaaccaaatactgtatgttctcacttataagtgggagctacgctgtaggtacacaaaggcagacagagtggtagaatggactttgaagactcagaaggggcagagtgggaaggtagtgagggataaaaaattacctttggggtgtaatgtacactacttgggtgacacgtgcactaaaatatctgattttacttctatacaattcattcatgtaaccaaaaatcacttgtattccaaagactattgaatttgaattttttaaaaacattaataaaataaaagatgtaaaaaaagaaatttatatatactcatttattgagctcccacaattaaccttaggaggtaagtacttcataattggtagtatacttatcttttactaaatatttgtattacttgggaagttgagggttggggagaagtagcaaggtactatgatttggggcagataactaacttatttattcgcacatacagtttggaccatgagacacgagctcaggtccctcctcctcacctaatcaaagatgaaatatgtgggatgggatgaaataatcagcagtccaatgctgagtttccagaccgaagtataaagcaacaatggatatgtcagaagtctactagggtgttatttatttaaatctatttcatggaatttactaccaccttaatggcccgaaagtgttaaagtatgccccagagtaccgaattactccctaaatgtaatttatgcttgagaataatctgactaacttgatttagaacatcagaaaataagttatgctgcacataaatgaagcagcagtgtaattttaaataccggttgcacggtgaatgagaattttaatatttgcaaaattctaaaatcacttgatttattatccttatgtttatactgacatttttttgccctttgttaagttccatccatatttcttcttactgccaagaaaaaaaactttttttcctagaaatattacagaaggcaaaaattatatttgtttccctgaatgctatttttgatgtctctacttgtttctcattgttaccatttgcttcattcatgggcagcccaattaatggagcgagacaaatttagggagcacagtgactaattagatattaaattggtaaatctaactttgtaaaaccagaaaaaatatatatatatttttttcatttggaattttccttggtggaaaagagtttaaaagtagtcatgataaaaaatgtaattttacgtagtaaattcaagaatagatttagactgtgctattaacagcacctattaaatactgaaaagtgtattttaaaattttatgtgaggcttgaaatggagtctaaagtattattactcacattaagtgtcatcacatgtaaagcccatgattttattctttaatattttgtttgaatagttacttatttcaacagtaatttcaataataaaattaaatcaactttacagttttcaaaggtttagcagttgcatgctgtaataaatacttcatatttatatatttataaagtgacagcataagtcatttttattaggtccttgaggatgcaaaagtttggattatacgaggagacgagagaaaaagggaagaagggcatttcagaaatatgctaccgatatgcaaattcacaagtcctaagacagtagcaggggtcgggcagaaagtccatcctgcctccctcttgtgggcctggaacaatggtgtaagtggaaggcctgttccccttctcttcctacctccagctctgtcttacagagctacggataccatgagcaagtgtatgaacccttacggttttcttctcttgggagaatgtaaaggaaagataacttgtagaaacttgtagataacttgtaaaaaggaaaagaattcagggtgagagggggatttgttgaatttgatagaggatggcaattaccaatatgatgagtgattgagaaacaagtctgtgcaacaggtttgaaatcgaaaatctttgaggtgtacaggatcctgaaatgaagaatgggcatttatagcagtatgtcagagaaacagtcacctcctagtagctaaaagtgttggcaaaagtatagttcaagtgattgggtaggaaaaacagcaaaccaagagtggagactgatggttgctacaaaggtggagtggtaagtcgtgaccaactggtacttctctgtgctctggttagctgctgactgtttctcagactgtggtagcaggaggagggttggagttagcagtcatttgcatatgagactgccatttaaaaaaaaattttaaattatttcatttttctgactctcaatatgaaaagcacattgtagacaaattgaaaaatatagaaaaattatataagaaaatatagtctcaccagtatggaacaatgctaactatgttgcatagatttttagattctcattcaaaagcaactctttgactccagtgatgcaaatgcatgtaacatatgcaatgtgcaattcatttttaaagggaataaacttacgatatattcataggtcatttattgtgtgttatataccattgaaaatatatgaatgctaaattattagtaaacatgcaaaaacattggcaagatcattttgttgtggaaggatatattgtatctgaataactctagaataccataaatcatcaaaggcaacattcttatttttcactaactacagttagagaatacctcttcggctaccttcggttgccttttttatgctaccaaaatgctgtctgttttacaagattttaaaggttaagcatataattattcattaaatacaatgagtgcaatgtacatgtagatacattattaaattttgggtagttaataaaaataaggggaaaaaacctctagaactatcacttttaattgtttaactgataaagtgaagcttcatcttggaaaaataatttcacaagagagcatgtgcactggtagaaaagtgccattgaaacaagagatatttgggttagaagcctctctctactatttaataccattttcaccttttggcaaattacttggcctctgttttctccaatggaaaatgggaataataattgttatgctgcagggttattgtaggtgtcaatgaaatgatgtgtctggcactataaaagcacagagcccggtgcctggctattagtaactgtttaataaatgttaattcctttctctgcccaggacatcagtaggcagatgtagcaatttaaaacttctagtgttactttaaattcctgaatgaaggtagaggactgaaaagatatcatggtattcaaaagtatgatccattgcttcttaagaatagagttcagaaaagcttgacagattcctgtactctgaggcagcaccatagccggtaatctgtaggatggctattggttttgtgctcacaaatgcttgcttgggcaggccccaggaaatctggtagactgtaagcccagtaagatttcaaatcttactttacggcagtgtttttcaccttgactgtacattgaaatcacctggatgctttgaaaaataacagcgtcagtgtccaacctccagaaatactgattaagttggtctggaatggagccccaggatcactgtttggttattgttgttgctgtgttttaaatgccccagttgattcttatgtgcaactgtcttaggtaaacatacagccctggttcatattatttctgcctcagtctcttttatgactggaaggtgaccaaatgcttgtttcctaatattctttccatgtgtagtattaacacatttgacttgtactaagttcctgcagtattccaatctaaaattttagtgactacaataaaataagaaggattaaagaaggcatcgcatagtttagtatatcggttatttaatgcttacatgtgagcctacaatatgaattatatctgtcatcttattttaaatattgacagaatctttaatgatagtgacgaattattgatttattggtgtgataatggtattttagttatatttttaaagttttatttgtaataactatatgtatttatggggtacagtgtgacgtttcagtgtaatgtttcattgtgtaatgatcaaatcaggtttcttggcagatccatagcctcaaacatttataatttctctgtggtgagaaaatttaaaattctctttcactattttgaaatatacagcacaatattggtaactttgttcatattactatgcaatagaacactagaacttattactcctttcagttgatgaacaggcagttttggatcaagaataatattgaaagtgatagaatttatgaagtaatttttatccaaaaatattttgaaagggaatatattgcttccaaataatttattacaatgttaagatatttgtaaatttctagaattaaaaaaatatatttttaggaaagaaaatgccaatagtccaaaatagttgctttatctttcttttaatcaataaatatattcattttaaagggaaaaattgcaaccttccatttaaaatcagcttttatattgagtatttttttaaaatgttgtgtgtacatgctaggtgtgtatattaatttttatttgttacttgaaactaaactctgcaaatgcaggaaactatcagagtgatatctttgtcagtataaccaaaaaatatacgctatatctctataatctgttttacataatccatctatttttcttgatccatatgcttttacctgcaggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggtaagtctttgatttgttttttcgaaattgtatttatcttcagcacatctggactctttaacttcttaaagatcaggttctgaagggtgatggaaattacttttgactgttgttgtcatcattatattactagaaagaaaattatcataatgataatattagagcacggtgctatggactttttgtgtcaggatgagagagtttgcctggacggagctggtttatctgataaactgcaaaatataattgaatctgtgacagagggaagcatcgtaacagcaaggtgttttgtggctttggggcagtgtgtatttcggctttatgttggaacctttccagaaggagaacttgtggcatacttagctaaaatgaagttgctagaaatatccatcatgataaaattacagttctgttttcctaaagacaattttgtagtgctgtagcaatatttctatatattctattgacaaaatgccttctgaaatagtccagaggccaaaacaatgcagagttaattgttggtacttattgacattttatggtttatgttaatagggaaacagcatatggatgataaccagtgtgtagtttaatttcaacttgtggtgtcctttgaatatgcaggtaaagatagattagattgtccaggatataatttggttgctaaattacatagtttaggcataagaaacactgtgtttattacacgaagacttaattatttttgcatcttttttagctcaaattgttcatgttgcaatagtcaatcaagtggatttgaattgtagccaatttttaatgccagaaaatactgattaagacagatgagggcaaaaaacacccagtagtttattaaatactttagatatttcaaaatgctggattcacaaaagcagtatcacatttgactttacaagtcttcattctcaaatatgtttccatagtaaatatgccctttaatattaaggagttaagcatttaaacacctatttatatgataagctatttaaacacagaaaatatttttaaaaccttgtgtaattatatgtgtatcaatcaaacttgcatgcacaccagcgttggcatttgtatagagaggaaatgtatggattcccaatctgctttaatatagaagatacattttaaaaatagcactgaagtgaattttgggctaatgtagcataatggggtttctgcctgagaggcagaaacatattagagttatataaaatgttttggggtagatatagaaaccacttgccattttcaatgatatccaacccaaggtagttatatatttcaatttatattttattatcaaattagtacttattgtgaaaaaaatcaagtaacatagaaatttgtaaaagtacctccattctactctttggaggatagttgttcagtatgaattttgctacatatttcaggctgggtttcttggaaagccattgtaaaatggagatttgtatgtagaaggttaactagggagtacttttacgatgaagcaatttgttttgatgtaacttggtgtagttttcttcatgtttcttgttcttgaagtcagttaagctcttgaatctgtgcatttaacatttcatcaaatttagaaacctttcaaccatttttttaaaaaaaatggaactccaattgtacatttattaggctccttaaagtgccccactactcactgatgttatgttcattgtctgtttggtctctcttttctctgtaatttgttttatataatctctattgtcaaattgactaatctttttcaaagtctaatctatggctaatcccatgtagtatatatttttaacatcagacattttcatctcttagaagtaaaagttgggtctttttatttcttccatgtgtctactcaacatgttcagtctttactttcttgactatatggaatacagatataataactgttagaatattcttctctactaattttatcatctgtgtctattctgggttaatttaaattgatttatttttctcctcattaagtgtgttgtttaactgcttctttggatgactggtaatttttgactatatgccagacattgtgaattttaacttagcgcgtgcttgatacttcaaataaattcaaatatattgaaataaatattctcaaacctcgttctggaacacagttaattcacttggaaacaatttgatcttttgagaatcttccttttatgctttgttatgaccagaacagtgtaagtttagggctactttttccccactactgaggcaaaacccttctgagtactctctctgatgtcctgtgaatgataaaatttttcactggggctcgtgggaacaggtggtattactagccacgtgtgagctctggtgattgtttcctttaattcttttgtgaagttctttccttagctttgagtggttttcttgcatacatgaactgatcaagactcagatgaagaataaaataaagctttctacaaatctccaaaatttcctctgtgtatatatcacctctctggtattttgccctgtgatcactagtcagccttgggctgctgaaactctcagcttcatcttttaacaaaagcctcctggcaaggatcactgtccttcaatgtctgatgttcaatgtgttgaaaaccgttgtagcatatattttgtctttttttttttttttttttttttaagtgtttcaggtgtttcaggcaggagattaagttcagcctcctttactccaacttgaaaacaagtccaaaacaaactattttgatgtaatttgatcttttaatacattaacattacacaattttgtgaatatatcataatttaaaattttcagagaatgtctaatggtcctcatttcttgacagtgtggtttagttgaaactgatgaacattttatcaaaacttttcccctcaattggatacttttttttttttgagatggaattttgcttttgtcacccaggctggagtggcatgatctcagctcactgcaacctctgcctccaggcttcaagcaattctcctgccttagcctcccgagtagctgggattacaggtgcccacccccacacctggctaatttttgtatttttagtagagacgagatttcaccatgttggtcaggctggtctagatctccgacctcaggtggtctgcctgtctcagcctcccaaagtgctgggattgcagacgtgagccaccatgcctggccaactggataattttaaaaagaccattttatttagtctattttttctcaatctatagatgagataagaaaaatcattctagatgtccaaggaaaaattctttcagaaaagagctgtgaatgatatcacaaaccccccaaacagttaaggtatttctttcctggttattttatgtccaaaatcatgcatatgaacatgtgcacacacatgagcgtgcacacacacatgaatacatatacacgcacataatgtaccttaggttatctttccattctgagtaattatcgtaaaatgggtaaaatcaaccccgtaagataccttcatcgataaggcaaatcaaagctttggtaatttctgctatcttggcctttgttgattgactaataatgaataagagaatgagtttcaatatttactatgaaattattttagaagacaggatgtagacagtggctgttagcaggcaattgtttggcatgagccagtaatggttactgtgaaaaaaatcaaccaagcagcccatatattaaacaaacacacgcagaagcacgttggagtctgaagcctcatatgtacaattttcagtaaagaaataacttttagatatgaaataaacaaatagatatatgttgtaaacttgtccctatgtattttgatcaaattgcatcatatttttttcactttaaagaagagaatttagtgctttaactgagacttagtgttatcattcaaaatatactgactgccaatagcagtagaaagataatctggttccatgcaactctattttttttcctctgtcgcaagtaaaagacaaaattaagtacatgaattagtgctttttgaagatattccagagcaatataccatgccactatggagaacctctctaaaaatatcccatttttttacctgagaaaaatattgatcatgttatatgccactcaaattggtttattaaattcgttgaatgatatcagcatctcttaatgcattcactaaacaagcagtaattgagtgcatatacaaagttttatcatccaccaaaacagtgacaatccacatgaggctctaatagaagtttagaaagggggttaagtggttaaatgctggactcagaaagattggattcaaatcccaggtcctttagcttaatagttgtagaatcttgtgaaaatatcttaattcttttcatgtctctgatttctcttctctaaaatggaaatataaatgagatgtgtataaagccacttggaatagcattttgcacaaaataattactcattaaatgtaagcccctattataactaatcactctttataagtgattagttcatatcaatacaaactaagacttatttactgaattatcgtctctaaacatccacactgcagaaaaaccaacctggaaatttcataaaaccttatttttatgtagtataatttcttctcaaagcataagggctcttggattaggaattgaggaaaattccaattcagccaaacgcatctgtttcagatagctgacacttctgcctactcatttcctagctaacaagaagaaatgttaatgggagttttcaaaggaaaagctgaacaccatgaaggaaagtgacacaaataatgttagctcatatattgacagggtgaatttgtgtgctttcaagtcccttcagtgaaaataggaaagtagaaattataaaatgccctaacatttaaagctagcatgttcttggagactaggaaaaaataagttttaaaacatgggctatgatagaatgagatggaaaatgtttgtagttgccagtagaaacaataacaattaccattagattaagtatttaaaccagctgaatatttttattaatggaaatggcatctgttttatgaaataatgctgctgaatgaaccatattaaaaatgaccagtatttcctgcagaacgttgtcgcagacatacaagcctgagaccctaaaatcttaaggtattccatttgaaatcgaccttaagacattaacagtagtggtattgtttagatgaaattttttaggctttaaatcaacaaatgttaagcagacatggggagcgaaacaccagtgtgttattctgacatgaataaactgctgtttttagggaaaaaatatagtcttgttaaggttaagctaattggttttctggtatcttttgcaatgttagtgtgttttactgctccataacctatgttatatggtaaatgtgcaatatatttatatatgttgctgtaaagaaatgtaataaaaaactgtttactttgtgatatgaaagtaaaaatttattcattgtcattgagcatacagaagtaaatatggattacatatgtcatattttaatgttcacatggtcccaccatcaaatgttgaaaaacttatagtttaacgtcatattctattgaagaaaaatacactcccttttctcaaatgtgaaatgtccagagagaatggaaaattacatataaagcatgtagttatagcatggtgaccctgctgtgatctctcagatgaggaacaaaagggagaaagaaagagcacactggtgctttggagttgagagaaggcaaaaaaagagtacaaaaatgtcaaagccaagtttagctgctcttcagctctccctttagctgctcttcagctttaccttaccatggttattagtgattgaagaaaattctaaagcactttttaaaggacccaattctgaagagtttagattcagagagcacaatggagttggagtgactcctgctcaaaagtttgagacaagcgagtccatgaaaagaccgtcctcctcttaatggaaatacccaggttttctcattcttctcgccttgctttcagcactcgcagcccagaaagcccttatctaacaggtactgccgttgaaaggtcattgacttgtacaaaaatgatgagtgctgaatagatgtgcataggtcactgacagtatctgctacagagaatgagttttcgtatttttattaggatacacctaacatggcaatctactgcctcaaagaactctataggaggtaagtgaatttatattaatacagattgaattaaaggataatctagaaaaaggcatatgatgtaaaaaaatcagacacaagtatattttctgtatagtcagtttttacattgtgatttcaccagctggctgctgagtttgacggcttcttaacagccacactgctgagattcaaatgctgatagaaactttgatggaaaaatcactggagtaaatatttctaccatctgttgcccttcactgggaccctaacgttaagaataattcataccattgcttgtcctttatatttccccagcagtaataaaatttcataagattttgttttgtggtcacaaagctatcctggtttctgtaactagaagacatacactagcataagggaatcagccggaaaatttactgctaagagaatttgtctctagtcacttactttaaggttacagcaatgtgtaagtgtgggaatacattttaaaatgagcttttcaaagttattagctggtagtggcatgagagttaagtctcttaatacagttaaacagttgggcacttcatccttgcgtaaatattgttacccttttattgctgcttggaaactcctctgcaactttttggcccctatccatcttttcagaagtagtaaataaccaatttactgggagtgtggtaccaggcagaaattccgagaggggctttcaatccttgcccatcaagtgtatctttcagaaataagtatattaaaataattggataatttcagtggcttgttattagacttccgttgtccagcatggcatgtttaagaagatgacagattttcatacattattggaaagaagcaagaacaaaaaaacataacttactgtagtaaccacggtaaagaactgcttaaaatgcaggataaacatgtcatccctaagggattcccattcttagagcatgaaattatcaagagagtaagagactacaaaaaatgagaagaatgctgattgcaaattccaaatagaaaaaatcaaaacaaaactgcgcaccatcattctggaagcaatgagaagcagaaattgtcatttaatgaaatgtaagattaaagttaatagaagtaattttcatgaaataatattttgcaaggacgatgttccagccatattgatcttcgtgttttcttttcacatcccttcttactgttccctagaatgcttgtttctacctttaaatttgcttttctctctaccagagggctctaccctatctccagtttctcaccatgtcccaatctactccctctcagaatttttgtacacttccctttatatatatttgtgctctaattttatattcacagatatgccttttgtaactcccccatcttaaagaaagcacacacgtacgcacacatgcacacacacaaaattgaactctttctgggagatctgcttaactttcttcataactctgtcacttgctgaaactgtagtatgtgttttcatgtttattatcttttccattagaatgaacatattttgggtacttggtctttctcgatcaccaatatacctcggtacgtagaaaaattgattcatatattgaaaatgtaatattcagtagaacgaataaatacataaataaatttaaaaatgatacttttattgtattacctgagacaaatgatccccaagtttgtccttgcttttcatagccaaaacattctctcttacattgagcttccttcacctcttctgtgtacagagcacttaaaattttcacattgcctgatactttaacaatatgatggccctgttctcttacccattggagcatatgttaaataccagaacccatgtaacaaacatatattgtgatcctactgtgtgcaaagcagatactgcttgctgctaggaatacagagctgactaagagctccttttctctttatgagctcacagtctcatgagttcaacgtcttaaggcacaacgtctaaagcaaagggcagtaagtaaacactccagaaagtactggatctggcctaggacaaatggtgggttgtttttccagctgttatttttcctgccccctaattgacagtcctccattacacctctgggatacctagtctgacttgggaaaacctgactttgggaatcagaggcagtctctcttgcttatatatgaggaactctaatggatacttactgtcattagagaaactctgcttctagcctggctccttttgtaaagaaggttgagtccccttggagagcctgcagaacataaccatttgcatgtaatgaacagtttgtaatactttgagattgatgtgcaatttctatttgacaagggaaaaacaattaggattaaccgtggtcgtatatcccagaataccaacgttgtttccacactctaagtgttgttgggtcattatatgagattcataattttgtcctgttgtacccacgtttgcattaccattcagtcttaatttattataccctattaaaagtttttttggtaatttgttcttattgctactcaggcattaaaatgtctgcaggctgtgaaaatgaataaatttaatgtggcagcatagttctcaaaatcctggctttacaactcatagtacaggcttgtattgtaaatcctagttaacatggatttatttgaaaatccaattttactgctaatcttaaataacacatttttcaaacattttatccttgaatttctatttttttataatttatggctgttgtatgtatttacaaaaggacaatgtgtgtacttttaaatactagtaatggattgctgaaacaactgtaactttaaaacaatgcaattgttaaaaaaataaactgtgcagcctggcttaatggaggcttatgaacatatgattaagatatatgctataataagcaaattcactcaactgatagttcataggaactttcaaatttaatctcataaccagtgctatccttcaaagaatggtcagggcaatttaacgagtacatgaccacgcaagataatttcattgaagagtggctgaactgttgaaatattttctagtctccttgggatatcattaagagcagaaattttgaaatggaattgtaatgatgttcagaaaagataagtaggtaactctcttaatacgttttgtgctgctgtaacaaagtacctaagactaggtaataatttgtaatgaacaaaaatgtattggctcacagttctggagactaggaagtctaacattaaggtgtcagcctctggcgagggcctacttgatatgtcatcacatgatggacgattagagggcaagaaagatcaaaagggggctgaactcccacttttataagggaaccaaacccactcgtgagggtggagccctcaatccttaatcacctcctaaagctcccaccccttaatactgtcacaatggcaattaaatttcaacatcagttttggagggaaaaacattgaaaccatagtagtgatactgactactaccacacagggcttgggaggctaccctagctgttgcacccaagagatgaatcttctaatgtgattacctttatcattttttttactttattaaaatacttttattttacatgtatacttttgtctacccaccatttccatgtctgaccactgctactactatgtcctagcataacattccatacatccttaaaaccaagcaaagggtggagttccatctttaaaaactaaacaggcattttggacaacacattcttggcaatggaatctggacaacatttatcaaacatggtagggaaggttctcactctgcattatcaaaacgacagccagatatcaactgttacagaaacgaaatcagatggaaaatttttaacaaattgtttaaactattttcttagagagacttcctccactgccagagatcttgaatagcctctggtcagtcatctggaagcaattcttcacataattcatgaacttggcttccactttaggaagagaaccacctttttctatacttgcttgcatttttgctttaatgtcttctacagaactaggtcctttgggtgttttaggagtttttccttgttttgaaggattcttgtccttttgatcttggtgttgacggttttgagtcttttccattccgatttgacttttgtgcatttttggctggagtatctcatatagatttcttcactggcgctttttcttcagtttcctcatcatcaaaatcatcatcatcatcaaaatcatcatcttcatcagcagcaagttttacttttttctgtggaaccttgctaccacctccaggagcagatcgctttccagatatacttatgagtttcacatcctcctcctgttcgtcttctgactctgtatcttcctccccagctactaaatgctgtccactcacatgcactggccctgaaccacacttcaaccgtaagaccactgatggtgttatttcaaagccctcaagggaaaccatgggctgtacagacattttcaaagctgccagtgttactttaattggactgcctttgtaactcattgcctctgcttcaacaatgtgcaatttatcctttgccccagcccctaaactgaccgttcttaaagataactgttgctcaatttcattattatccaccttaaagtgatcatctttgtcggcctttagttcacaaccaaaaagatagttttggggcctcagaggactcatgtccatcatcgtccatcaggtggcaggacgcacttaggtgggagagaaggcagatgatgataaaggaccactgctcaagagaacagctgtgcaggacagaatcacaccagggagattacctttatcttagaaaacctgaacatcttgtgtactttgacacttctctacatttcacctaacctttaacatcaacacatttattcagaaaacttttacttttggagctgctctgtgtcaggctctatgctaggtgctcaggatattgaaattgatacaatcctaacctattcacatataatccaaggtttgctgaaattgatggacatttaaacaattgaaacatttaagtggtataattagcaaatggacatttaagccataaaaatagcatctaatagatataatagaggtcggtacaccattgatgagtcagagcagaggcaacccaaagagtaactagccagaagaattgggaaagcttcatagagagagcgatatgaaaataagggagagaattgtaaatccatgaaaatgagaaaaagttgaaaagtgatggtgtcagaaaaacttgtggtatgataatgacaagatgagaggaactcttggtaagcgtgttggatgcatggaaagaaatggcacaaaataatgctgaggacattttttattttattgttggttttgttttggttaatttcattttttaaatctagtatgctagtgttcattgtccaaactgtgaatcataaactcagtttgtggatcaacaccggcctttgatttttagtgaaacaaaatagaaaatatcagcattcatcacaaatagatgtttcacagattttttgttttaattgcgactgtgtgtgtgtgggtgtgtgtgtgtgtgtgtgtgtgtgtgtgtgtatgtgagagagagagagagagagagagagagagatggcttggatgtttatcacctccgaatcttatattgaaatgtgatttccaatgttggaggcagggcctggtaggtgtgattggatcatgtgggtggatccttcatgaatgatccctttggtgacaagttagttcatgctatatgtggttgtttaaaagagtatgagacctcaacccccacctgtttcctgctctcccctttgccttccaccatggttggttgtaaacttcctgaggctctcaccagaagtagatgccagtgacatgcttcctgtacagcctgcagaaccgtaagtcaaaagaaaaccccttttctttttaaagcacccagtttcaggtatttctttatagcaatgcaagaagggactaacacagttgtatgtgtatgtgtgtgttgggtgatttctggttgagtgtcacaaggttgtaatatggtgagtgtaaggaagtataagttttagaaaattaagaagccagttcagaaaactaatacttttggaaaatagtacaaaatcaactttacaagaatatacacagaaagatgtaatacaagatttatttcattgcagtaatttataaagttggtttagtgccttgcttttgcatgctgttttaaaaattaccaagaatatgacttcatgtgattttgaaatactcccagcaagataggtagaaaaggtattcttataactcttagacaaaaatttcggaaagtttaaacgctttatcccaaatcataaagctaataaatgaagaatctgggattcaaacaccatattttttttactgttcatcagctagaagttagaaatgttaagccaaaaacattaagtcactgctctgcctaataaatcttgaggaaactaataaaaagaataataccactgactacaggacaaggtcttcctaagagaccttaaatatattaagtgatgaagatgaaacttcttttattcataaaaatgttatttagttatgagtagagctctaattaaacttattttatattgtcatcagtaaagttgagacataacatatttattaatataattataatttgacccatagtgtattaaaagaaggatgttaaaaggagttgttattagagatgatgttagggttgttgatgataataacagtagtcataacataacaaagcacttcataatttaagaagtgccttcaattacattgttactctcatggtaatctctgtttgatatatagatttggcggattctatatcactctaagacataggttactgaggtgacggaggaatttagcaagcggctgtcaaatggaggacatgagcattggattgtgtatggcaagggctgatggtctctaagaaagcctcttggtttccacagggcagaagccctttgaagatcatagccaaggatttagtaattgcctccctttcagaataccctcaagagaaaagcccaccataagacatggttccctacaggcaaaactgcttttccttaaaatttactgttccctgaatatcagccttctttggctcattcaacatagttttcttaagtttcaggacagtgctgcagaccaaaagtttcaacattgaggaaaacaatactacttgtgcagtgaccctacctcagtcagggaggcagatgcctgcctttatgtgagggaataaggaatcaatcatatttccagcactcaagaaagccagtctagtgcagggagagatagatacataaacctcaaagttatgatatagcataatagttttaaatttccataataactgtattttaaaagttttatagaaacagaagagatgacctcagtctggaaaagccagcttggagaatggcaaccaatattaagtggcaaaagctttgggatcccaggcctccagatggagggtgatagcatgggccagacaggtaggttaggaaaactttgcaaaggacattacacggtacacagacaagtctgtgttttagcctataaaccacagttgcagaatgtgtttgagcaaaggcttttggggatgagatttgcacttttcaagatttaagtttgtttaggatacttacggtttgctgtatacttcctgggtttttacattataattacggtttgaactttaaaggaaaactgcagtttagcatacttgaaagagtgcaacttcaagtcatgattggagacagatatttaacagattttgtgatcctgtgatgcttattttcttctcagacataccacatgacaatcatttttaaacagtttatttctactttagcatccatctgaaggtgttgtgtatgttttctgcttgaaaataaagcagtgggctgggtgcggtggctcacgcctgtaatcccagcactttgggaggccgaggcaggcagatcactaggtcaagaaatcgagaccatcctggccaacatggcgaaaccccatctctactaaaaatatgaaaattagccaggcgtggtggtgcatgcctagagtcccagctacttgggaggctgaggcaggagtatcgcttgaacccgagaggcggaggtcgcagtgagccaagatcgtgccactgcactccagcctggcgacagagtgagactctgtctcaaaagaaataaaaaagaaaataaagcagtgaatgcgattaagatggatttattatgatcataaagtactcaggagtcttattttaaaagacagcattactgtaattaaaaatatagggaagaaactaatgctgttttgcgtatcattctcagctctctcaaaatcagatattaagctcttgctgccaaaggagactatactgcacggtgctcacctgcataaactttgagagggttgaattgtgccaagcaattctctcaatacataaattaaccaaatatttgttgacctactgtgtgacaagtattattccaggaaataagagatccagcaatgaaacaagtatggcttcttatagagttcccaaaaaggaaataaaaggatatacgtatagtgatatccctgaattaaatttctcttttgaaaataaaaattctatcataagctgtaactgccaacacttcaatactcattcagcagttttcagggatttgtaccttttgacttatgagaatttggaagtctaattgtatcattgcactggagtcttaaagaaacagataagcgaatgactttgcctgtatcattgttgactgtacttacaatcagaaaggggcacaggacagatgccagggagtaagtggacagcccataaatggaatggtaagaaagaagaactatagtggatttggaaagttcccttcagcattttccctagacaatctttggctgtgtttgcatgatcagtatttcattcacaggatattgagctcttgatatagttctcaaaacccaaaatgaaataagaagtctactctttatttaaattcaaattccagagagttaagtaactttccaggaggtaatctaaatatggcctccttgttggggggggggggggtgtttgaatttgcatataaatagtctcacccttaaaggaaaaccacagatggtggtaatgatgtagtcataatgtacatctccacagtggtggaacaaaatatccacagttttgctttccccagtttcagtgacccatggtcaactgctgtctgaaaataggtgactacaatacaataagatattttaagagagagaaagaaagatcacattcacatgattttcattacaatgtattgttataattgttctatttttattcatgatttttaatctcttaactgcgccaaatttataaattaaaatttatcacaagtacatatagtttatatagggctcagtactatctgcagtttcagacatccactgggagtcttggaatgtatcccctacagataaggggtaaaccactgtatcctatttgtgtgaatgctacaggtgttgtgagctcataacaatatgacatcaacactgaactaatccaggatttggtagtgagagtgatgtatttgcaaggagtgagacgtggtgcctcatccaagcagagaaataattttgaaatttgcctgacaataaaaatcacaatgtgaggtctctctttagagctgcaaagtccaattcagtgccccctagccacataagatactgagctcttaaaatgcggctagtactaattgagatgggcactgagtataacacacatgccagggtttgaatacttagaaccaaaaaggaagtaaatgctcatttattgcatgttaaaattatggttttattatagttgattaaataaaatatataattaaattgacttcattttgcttttaaaaatgtggctatgaaaaatttcaaattatatatgtgtgtgattacatatgtgtgttttcacatatgtaactgatgttacatgtgaaattgattgttacatgtgacatgtaaaacacgttacctaacacgtgcatatgtatgcaacacatatgtaacgtgttacatatataacacgttacatatgtattgttacatgtgtgcttgcattacacacatgcataatatgaaattacatgtaatttcaaattacatgtgtatattttgaaaattacaaattacgtattttgttatttttgctttacaaagtcaaatttaccctatttaataaagcatcatgagttttttataactagtaaactttgagacttttgtaggagaataaataatgcttattataaaaactgattggaaaagtgagctggagcagggagcggaggaaaaaggactagagatcacctttcttcccagctccgctcctctcccaaccttttttctttccattctctcatcccaattcaaaagtgcagagttcacagttggtgtgctgatttagaaaacagatatataaacagccttaaattttctccaggcttttacaatgaaaagaagttcaatatcaaaagtaacaatataatctgtggaaaggtatagggggctatgtttttgaggtagaaactataggtgctcctggccaagcatggtggttcaagcctgtaatcccagcactttgggaagctggggcgagagtattgcttgagcccagaagtttgagtctagcctggcctacagggtgaaactccacctctactaaaaatacacacacacacacacacacacacacacacacacacacacacacacaaaagccttgcgtggtggcgcttgctgatagtcccagctactcaggaggctgaggcgggaagattgcttgaacctgggagacagaggttgcagtgagctgagatagcaccactgcactccgacctgggtgacagagtaagactgtctcaaaaaaaaaagaaaagaaagaaagtataggcactccttatatgcagctgctcacacccctcctccttcacacccctcccccttcacacccctcccccttccccaaaatttgcaaggggaaaaatgtgtgtaattggcagtatttagtggcgtgcaaccgtgagtcatcagactgcacatcctcacttctgctagtggctcagtacccaacagcactcagtgaaaactaactcatttcaaaggtgaaaacaagtgagtttggccaccagggagtgttcaaaactgtcagtgctgaagcaaatgtggagggtgttctgtagtttgttcaggttgatatttgtggtccaacccctagctgaactactaattattaatatctgtcttgatggtgcctcaggagaaagcttctcaaagggaatcaatgttcaaattatagtaggtatcttggccatggaagttattgaattttagccaatacttgctactctttcatttatagtgtgagaatgcagtgtaatgaacctgactctcactgtcctgacttgcctttctcatcgcattcacaataagcacgtcaatacgtatacacatttcatatttctaaagtttactttatttccttattgtacatcgctgtgctgctgatggaagagaaaaggaaaaacactattgattgcaaaactgttttatctttggtggcttagattttttttgtatgatatgtaacgtcttgcatacctaaggcaacacgaagctaaatagatttgcatatagcatgtattttttccaattaaatgtttaattttgttcagagtatactggggacattttgaataatggagaaaagtacaaagaaaattcataattctaccacctatcagcacagtgaaattttatgaagaaacataattttcatgtaaatcatagtgaactcacggtaggttttatttaatacagtaattggagagctggtaggaagacaaaactggttcaaaagagaatacaagaaacaaatgcttctataatgagtgaatttttaaaaaagtattctggaataagattagtgaataagatactaaactcgttgataccctacagcctttggggttatatcctctactgggtaaaaagtcatttacatcatatcagttttctaaaatttgcattgaacttcatagcgttgtaacatgtgtgggcccaaattaatagtaaacagtaagagttgctttactctgaaaatattgaagctcttgtgagggtgtgaggagtttgttagaaaacaacgctaccattattttgaaacacacacgatcatcttttgttttacttctaagttttggataatttttcttaaattatcttattatcttatccattttcttaatttccttaaccttttaaatgtttctcctaggcacttttattgatttttggaatatagttgatatgtgctgaatttttatcatccagttttaattctactgaaaaatctaaaagatgttcatcaactactatatttcaaatgcatacatcccctttcatgctaaagaaactgtatgggaaacacagtctgacattttcaggacctggtatcattaaaagtcttgacactgttaaaattaaacaacgccttttttaaaatcaaaggatacaaaagggctgtgttggtcagaggatacaaaatttcagttagataggagacataagttcatgagatcttttgtacgacatagtgactataattaataataatatgttttcgaaaattactaagagagtcgattttaagtgttctcaccgcaaaaaaatagtatgtgaggtaatgcatatgttaattagctcattttagctagtccacatttttcaatacaatgtgttgtataatacgtgatatatacaacttatattttccaattccaataagtaaaaataaatgtaaattatttgaaataaataaaatgtgaagaacatccacttttcatatgaaaccatgagatattttctgttaaaagattaaatgtccaataaatttttgatgttaacagaaacaaaaatgtttaatatttaaatacatatttgcatgctattgaccccctgaagttcactgctgggctaagtgaaccaactatatcttaagtcaaaaatgctgaaattcttccccaaatcccaaagctcatgaaaacataaacagaaaatttccaaataattctacagggaaaataagacacactatttgatctgatcaaacaacgggatgattatggttaataatgagttacttgtacatttaaaaataactaaaggagtgtgattggattgtttgtaacacaaaggagaaatgcttgaagggatggataccccgttctccatgatgtgattattacccattgcctgcctgtgtcaaaacatctcatgtaccctacaaatatatactcctacgatgtacccacaaaaattaaaataaaaaagagagggacccgaagataagctaatatttaagctcatcatacttattaagataagcaatacataccgaaagtaatagcatttaaaaccagatgttgggggagggttctaacttgttcattaaaattcaaagtcacctgtcttgttttttcttttgtttttgtttttttttttttttttttgagatggagtctcgctctgtcaccccaggctggagtacagtggcgcgatcttggctcactgcaagctctgcctcccgggtttacgccattctcctgcctcagcctcccgagtagctggtactacaggcgctggctaccacgccccgctaatttttttgtatttttagtagagacggggtttcaccgtgttagccaggatggtctcgatctcctgacctcgtgatctgcccaccttggcctcccaaagtgctgggattacaggcgtgagccaccgtgccaggccacctgtcttgttttatcatgatcccgagagtatatatgtatgtgtacagctcatctaaaccctttttctttcaacatgatcaatagattgaacattggagatattttataagaaataatgaagacaactcaatcagcacatatatatattaaatgtggaatctataatgattgcgaagcctgaagcaaactaaatattcagtaataggttctttttttccatggtatatccatttgaatatataacataaatgccttacatttgttttaactatttaaggtttatgttgttagtgtgatgaaatggctggcaaaagtcagaaactcaggaaagtttcaggcttatatctggagcctggttttctttcttcaaggtagaacctctgtgaagtgaaaaattttttttatatctggagcaataatgtagaagcttaaatgtattatccaagttgtcataagcctattatttctttacattactgaagtgaaagacagcattaatggctaaatgccatacttggctataatttatattgtttaggactggaaatgagcctgaaatgtacatttttttccaaaatagttcatgtaatatttgaaacctgacaagtaacctgatgatttcatggaataccatcaaatataaatgtgaagttttaaagacacagggaaatactcagaataaaccccctaaccacaggccagcagaagaactagacttgagaaaatgaatgggaagatagatagtaacaaatgacttctttggcagccttatatatgcttagtcttatagactgttttatggatgctctgcactctatttccagcaagtatggcatttggaacaggaccacacgagacaaactatgagttcacatttcccacaactgcacagatagaaagagggaacaacagaatactccctttcttcttgaaacaataacttctgttgaagctcactggcttcttttcagctgtttctgctagctcctcctccgcctcttgacctctaaggcaatgctcttcaaaatttcaagactgctttctaattgaaacaaaacttataagcacatttcttcccacaaaatgtacatttatttgtaaatcatatatgaatatgactaagcatgtaaacgtatgtgaaaatagaaatcaataaatataaatgcaaacacaaatagaagcattcacagttttcttttgtgtcccagtgagttgttccaaattcctcggaggtaggtatgtcacagtttgagactataccttcaatcctagggtttctggtttcgctctcctcctaggtgatagcatccatttctacggacttaactgccatctttagttgaataactcctctatctttccatcccatatttctcttgattccaaacctgcttgttcacctgagcatatgacacaattcattggctgccgcacatgcagctttgacattttatttaaaatctttccccttccccagccctcatctatttcacagtagtatcttcttcttatctacttgattggtaagcagagtccacatgattccatcatttatctcccattttatatctaatctataagcaagtaatgcaatgcaacttctgtctccaaaaatttattttgaatttgccttctcttcctctgcatctcccccatcttaggccaggtcacctctgccctcttgccagattaggtcacattctcttactactgttgttattctcttcctattcaatcctacaccgcagcaaaatggatcttctcaaaatgtcagctagataaaggcatttctgtgcttaaggccctcatggatttatcttattaggatgaacacccaactctttattatggcttagaatacaatgaattacaacacataatgaatatattatatttctatctttaccattttcttcttaagtcaacctttctcaatccatataggataatcatattagtgcttcctcactttctaaaacatctcagggcctttgcacgtgtttctctgttcttagacccagaatgctcttccttttctctttgtgtagctaggtgcttctttccatttacgtatcacatgaaatgcagtcattccctcctccttccctcactacctcacaaaaagttgatgcctctgttaaaccatgaatggaattttactcggcagtgaatagaggaaaaaccaatggtaaaagcaaccatatgaatgaatgaatgtcaaaaatattatgctgagccaaaagtcatagacacaaatatgggtatttacatgaagttaaagcacagcaaaactcaattacggtaatagaattaagaaagtggttacctctgggtgagggttggaattgagtggacagaggcattagtgactttttcggggtaatggaaatgttgtctattttgttcaggtggtgaatacatagatacattcaattgtcaaaacacatccatccaaacacttagacttttgcactttattatatgcaaattatgcctcaactgaaaaaagtttgttttcaaaattatatcaacagttgaaattcttttaaagatttgattcaaatgagattaattctgtatccatcattgatgtatgatagttttgtatgtagttaaggttattggagataattgaaagttatactcacaagaaggctgcataatatgaagtttatctgccttgatctttaatagctttcgcgatttcaacttcttcacagctctgtaagaaggcagtgtggcatgttgaagcaagcatgtgttttagagtaacacagagctggtatacaaccccatgtctaccaattatcaatgatgtgggtatgttgctggatctcaataatcttccactgtgaaatggaatgtaacacctgactcacaacgcaaaggtatttaccttatgtaatataattcctgcgatcctgggacctcccttaatcccatccacagatgccaggttaaagaccccatcacagactagaacaagttgggatgtcaaaatgaataaatattaatcgaagggcctattgtgattgaacaccacgcagtaggcactctctaatacctaccgtctccctcctttttgggggaaacattctaaatgtgcaaaaaataaagggttatttgctttctggcacttgggatcgatttattgaggatatgttagcagaacagcaaaggtgaaacactaaaagcaccatcaatacacaggcagaggtgaagccataaagcctttattttttaaattaatgcacaatatataagaggtatgttagaatgaacgtccaatccctgaaaggatatacgaaagacattcataaaattacatgggcatgttttcttaatgttcaaaatattgttttaattagtgtattatgagtttattcatgtgtctgtgtgttgtgttatattaatcttttcttgcattgctataaagaaatacctgagactgggtaatggatgagaaaagacacttacttggctcacagttctgcaggctgtaccggaagcatagcagcatctccttctgtggaggcttcgggaagcttccagtcgtggcagaaggcagaacgggagcaggcacttcacctggctagagcaggagcaagagagacagaatgaagtaccacacacgtgtaaacagccagatctcagagaactcactcatcatcatgaggatggcaccaagaggatggtgttaaaccattcatgagaaatccacacacatgatccagtcacctcccaccaggccccacctccaacactgggaattacatttcaagatgagatttgggcggggacacatatccaaatgatatccatgtttaatcagaaaaataaaagttaacagtaacagtgattttactttgtagacctttgctaatggctgaaatctagctccattccgagaacagcctgcggtacacattttgaaagatagttgattaatatgaaagaagccttatctgtagtccttaaggccattatggtttacatatatgagtaaatattccaaagtagccatgccagttaacatatatccagagtctaaaggccactgggcgacaaaagtaaaagatacatagcaattgttactttatatcacagtaattcttgtatattttaaatggatatttgcatttgaggatatccacttaagagttaggtacatggctcttacatttaagtaacatttacttaaatttctggctgcagcaattccacataggtagaaatgaagtctgaattgagttgggggtctttgcagtgctctctctgttcattggctattttgacaatgctgagagatgtggttagccattctttttcatttcatattggcaacctagagagcaattaagccttctccccttaactagatgtatgttttactcatttctggatctttatggctgactttgaatcctagcctgtggtagaaagcatggtgtcagaaggaactatgagttaagactatgcatacttggctttgagtcttgggtatcatacctccctcatagagtgaaggaaccagggattcttcttgaggcccagacccggcatccatgttaagaatacctgtgcaattttgcttcctgatatttaaggtgaaaatgcatgtttgggtcattgtgaggattatgtgagatgttacttttaaatataggcccccttattatatgctctcatagtttcaggcaacacttgtcgtatttgtaacctcagttttaactgtaatgtttccatcaatgtccctcttacctggtacaggggctcttcatattcttggattacaaatctgtgaatgcaaccatgcatcaaaaatattcagaaaaacaatgaatgcctacctctgtactgatgatttataggtgtttttcttgtcattattccctaaacagtacaatgtaataagtatttatatagcatttacattgtattaagtattataagtaatctagagatgttttaaagtatataggaggatgtgtgtaggttgtatggaaatagtatgtcattttatatgtcacttgaacatttgtggatttgctatccgtggggatcctggaaccaatcccccatggatactgagggacaattgtattataagcagcaagagggaaaggaatctgtctattttgcccaaaatcgtgttcccgggacctagcatagctcctggcaaagagtatacaacaaatatgcattgaggagagaacagagggaaccattatccccttattctcgctgttccttcatgtaatgaataaacagtcaaatcttacaagagattttaaaccagtcagagaaaagttggaagttagttagttgttcatacattgagaagcctcgacgctgtgtcatctaggtaatgaaagatctagggaagtttagcagggagaagaagagagatgatagttgtcttcaaatgtttgaaggactgttacggacacaaaaatttaaacttgtgctgaataattccaagaggtacacagtctctcgatagaagctaaagtggggggtgacatttgactcaacaaaaagccatctaaatatcagaactttcaaaagcaggaactggtgcctcaattaatagtgtgttttctagcacttatgatacctgatcataggcaagataatgaaaaattgggacctgggagttatacatgggaatttgtttatcagttgggtgattaggagaggtggccttaaagtcctgttgtgttctaagagtctgtgattctgagtcttatttcccaacaagagaggtacagagcagaagatgggattgggagaaataggataaagataccaggaaatcctaaaggtaagaaaaggaaggcagacctgaagctaactctatacttcaggtgcttgcctagagccagccctacctacttagagaatgttgaagagccagttaaaacatctttaacacggatgtaaaacaaaactatcaaaacctgaagatttcgaatgttctaacctactcgtcagttgggcttttttcacaaatacttcagtaaataggcataaatttattttttaatgatagaaaatatctcttaaagaacttataactgtggataaaagcaccaccataaaaatcttgtggtgaaatatatatatatatatatatatatatatatatataaaattttaaatatggttagctagaatatgacgacaatgtttatgaaacacagagactcttgacaagtcccatgtatacactataaaactttaagttatccactattcactcactaagcttatacttaatgagtgtctgctgtgtcacttattgcggaaggcacaggcggtatagcattgcacaaaacatatgtggtctctgatggagtttttcagtctagtggtgaaagcagtgaatgggtgtacagatgttaaataattgtacaattagttgcatgtgtaaacgtcaaagttcagaagatgacaattgatctacggcaatgtttctcaatctctgacgttttgagccaaatacatctttgttgtggtggactgccctgtccactataggatgtttggcatcacaactgacctctgcccattagatgccaatagtactctcttctttaatcacaaatttgtcccagacatttccaaatgtcccttggggagcaaaatcatccctagttgaaaatcactggtctagggggaggtctttatgaggaagtaacatctaagaaagctggtatgtttacatatagctacagtctattacacatgtatacatatgtaacaagcctgcatgttgtgcacatgtaccctagaacttaaagtataataaaaaaaatgtaacaaaacaatacagtatgataagtgctatgggaccaaagatgaaagggttctactgcacagttatgaactcatagttaggcttttggggtcaaaattttgctgaagatatttgccacccacgtgacctttggcaggtgacttagcttattcatgcctcagttttatccaatgtgaaatggggctggaaagtcccatgtacttcctaataactttgcggaaataatatgtggttatataggaaaaaaaaaaaaatcctagaagtatgcctgctgcgtagtaaaaggaaggagaaggataaagagaaatctgcattttttcttctgtaatggggcagatagtaaatattttaagttttgtggcccaaatagtctctgtcacatttacttgattctgcagttgtggcattggaagcagctatggacaatacttaaattagtaggtgtgcctgtgctttcaataaaattttataaatacaaagtttgcaaaacaaagttgttttttttttttttgtagtttgctgacaccctagtaaagaagcaccattgtcaacgttaaaaattatcaaatttttatttttcaaagttttcaaatttgctttgcttggtctagctcatgaaataagtcaaaagtagcaagacctccacctctaaaataataatagtaatgataacctcaaaaggaaagaagaaatatttttaaagaagaaaaattattgttaaataggattattgtgcagagaaaacctaggagactcaattttaaaatctgtgaaataattttaaaaatactttatgaatagatacataatagcttttattcatattaatgactataaatgcaaatggaaatatttcattcacactgatgacaatgtataaattaaggaggaataaaaattgtagaccctataggtgaaaagcataaaaatatacataagaaaaagcaaaaattgactacgtaggattgttttaggatttaagatttattgtcattaaacttgcaataccagccaagttaacatttgaatttaatacagttataatcagaatgcttttgatgtgtttgggggcaatataatttcaaaggaaataggcaatgatgtaatttaaagtttatatagaaggaaattgtgtgcgtgtatgtgtgtgtataaattggaaacaattttattaataagcatattatggcagcaacatacacttccagatttctactatactttgaagtaattgtgatcaaaaccacagtgtgctggcataaggctagagaaatgggttagtggtttacaagtgagagtccaggaaaacatccaaataagattggatattttagttctgtgtggatagcctatttcacttaataaatagtgtctcgtaattgactattcatgtacctataagtttaactatagaccaaaaaaacgccctactagattaaggagctaactagaaatataaattcatataaacaataaaggaaagtgtaggactttataagcttcatgggagacagatttttggtaagtcaggaagcctggaagacttaaaacataaaattggcagactgaattaactgatagtttaaagcttccatagagcaaaataaatcataaaccaagttttaaaatatataatggatttagagaaggtatttacaaaaatatatgactaatggaggttaataataacaatatgtaagaaggatatgaaatggcattttactataaaggtcaaacaaatgacctataagcataataaatcatattaatctccactagtaataactacacacatctacataatatagatgttacgcctgcatttgatttactttatctgtcttttggcagaactatttgtcaccagataaaaaattctatatcattaccagaaaggtatattattataatgtttattatgttgcagttgtaaaagaaataacagcttttcaattgtttacaaatcctatagaacatttactgaaatacatttacattttgtggcaaacttggatttaaataccgtgttcgtgctttgttttatgccgttttcccatcttttctccaggaatttgattgtgcttcattgaaagctaaaaagaaaaaaaaaataattctggttttggtttaaaaaattaggttaggggttaaaaagttgtacgttgtcttctgtaaaaataaaaaacaagttttctttgtttcttggaggctttatattaaatggatttttaattcatagacagcatattgtgatgaaatttccccatgagcttcacattttgtttcaatagcagaaactaacttggttgcagttactgcccttctgagaacagtgttctggaataattttgacatacatatgtatctctttttaaaacatgtgttaatcttttcataaagaaagttttcccagctgtgtcacctgtgactccaactttctggggggacagggatatgagatgttggaagggaatggcttgaagaaataaagtgcaaaagacgtaatgctttcctgtggtagaaatgtattcagtgaccctgaatgaccttcctactcttgtcccttcatttttcccacaagtatggtctgggcaattataaaaattgacatttgcagtgggctcttctgtaaaagatgctcaatcagaaatgatttattttagaaaaagagatgatataaacatatatatcccctgtctcggaagtgtgaaggttgaaaagcaaggagatgatcttcaaagtgtctaaaatattgatttgtaacatcgttttatgaaagtgcttcagattattttttttcttggatggccccttatgctttggtcagttgatgctaaaatctgaacttctttattttaaaaaaaacttttaattttgaaaaaggaagttcacggtgctgtctaattctttttagatagtcattaatgtaaatgtaagagtcattctgagaaccacatctgctgatatgttccgttaaattacaagttctatgtgtatttgctttgctttcatacaatgaatcttctttactctcttccccacctgccagaaattgccccactcaacgttcataaaaggtccattttcaatcgctatatttatttcagaagcagagatatcatatattcaaattttagttactttccaatatcaagctaataactcacacaaataaatcaaactacagcaaaacagcaatctagcattcaacaaaacctccccaatgcacatatttcaagctgtagatatgtatcatccaccatgctgaaataatgtacatgttcaaatcaaatggaaaactagaatcaaaattgttgattacttcttatcagggcattttattatatttaagaaaaatacaaattaaatcattttcaggaagcaatccttctggctaagatttttttagcataatgcttaaagttaattgttgatctttatctataaattcaaaggtggactaaaaatgcagaatcaatcaggtagtccattttgcatcaggtgaaatatataaagcataaaacagcgagttacatttcctaacaaaattgaattacagtgagtaaaagtgacaggacaaatgcattaagaaaagatggactgaaatggatagagtagaatatatgcatctataaaacacagtcatatataatacactcattttttttcttacgagtgtgagattaatggaagaaaacaacaataataacaaaaccagtgtgatgtgtcagatttcaccttttaattaaaaaattattcacttcagaggggaattttctttcttgggttagctcaatcatgtcagatcttgttcatttaaaaggtcagtttacttgccttctgaggtttttgtttgggaaaaagaaaagaaaatagattttcattggtatcctgggtagaattaattgtttatcattcatttttaagatctccgagaggcagaaaaaggggaactgtgcaacccttttgtccttctggatctcaaaatgaagggatacattctgctacatgaaatgtggaattaagaccatgatgcaacatgataaacaacacaaatttgggggtgtctctgtgctatacattattgaatttttccatgctatacactttttggatgtgtctgtgctatttattcagtttttttaaataaaagtttttgtagactaaattgccctctctactttgcatcgtttttgaacaaaggattttcaagactgataagctcaaatgtatcatttattgtattcaagtagcattcaatttttctttagaagtataatttgtagatattttaacacagaaaacttgcaacactgctcatgataggcacttattatatattttttgaaagactatatggataatgattctaactttgacttttcctgttttgccttcactttagaattaagcagagaatcaaatccatattcctgggggcgatgcttggacaacagtatctctttaaagatctttgtgtgagtcgaaggtgcagccagactgggagttattgtgaagaaacagattcaggaaggttgagaaacttgcctaaggctaatcagatagttactggcaatgttgtttctaaatcactgtttggctccctcattcaatgaatctacactatgtgggactgcctcttgctcctgacatcttttgctgctgaaataaatgaactcaaagcctagaaggtagaaaagagggagttcagaattatattcaggcacaaataccaataaggctattgcccccagaactgcaacttctcttggtttaacagataactatttagctgtgaggtacaactgaggaagtggacacacaagttatcaggagattctgatgtgccagtttatatttcttgtcacaggtaatgattcgaaatttcttaaaacagctgtcctcacagtggagtaacctgggagtacatgaaggcattccaaggagtaggcacagatagttttaagggaatttatttctagatcttctactttattttgtactcttcctgaaaactgaattgcctgaaaaaaaaaaaaaaaaaaaaaagacatctgtagtcaagacctcaggctgtttctcctttctaaccacttgccttttctaaccacttctcccaatttaagaaaaaaagccttatatttcatccaactctgatcttactaaggcttcaaacaaaagaagcatgaatgactttcatgacagggcaacatagctttttgcaagaagagtggttgctaactctttgctttcaactgaacccgaagagaagacctgataagttgtcagccgatagatcattaaaaatacgttttggtaagcaatcatcatgtacttttagcatatgccatagcaggagcacaaatgattaagcaatgctactataatacaattccttccgtttctttctactcacctatttgaataagatttttcatcatttacatctatacagacaaaaattagggatagaattgatgctgaagcctttccaattgtagaattaatttatattcttctgaaggtgtataaattgttaaatacccatccatcttattaagagatgtattttcaataaaattttatttttatgtttatcaaattttataatatacatatattgttttggtcaattgcacgttaataattgtaacaatacctcaattgaaaaggtttgttttttacatttaggacttacagtaacagaaaaaaaacactcattgtgtatacatactgtttaagaaaagtatactaggtgatcaataagattttttcaggcataaacatatatcttagttttaagatatcgatatttacaatgtccctcaaattatattattttcagtcatttaagaatgaaaagtacatttcgaatgcggattttaaatctgcaagggttgactcatttttcaagagtctttttaggggatacagaagcaagaatgtttggagttccctgatcagtatctttaagagaaggtatttgttggtagttcctagcaaattccaacagcctgatgctacttaaaagataatagtaattattttaaataatgcttctgataaaaaacattcatgcacactcagtttaaaaagatatttaaacatttgtagttgtagtttgggaactcatgatacaagtacagtctgtaaatgaagctcttagtttgcaaatatcagagataagctattaaaatgcagaaattgaaattgccctgatatatgcataaattagtgtcatctccatcttgtcagttagagtattttttagattctctctatgtatacatacatatatatatatatatatttatatatatatatatatttgtgtagctgtgcatgtgtgtatttggactaatgggtcaaaggacagtactaacccaattcaataattaaagaaaacataattttgagaattagctttatggtaattgtttgacttaaatgagtagatcagagaagaataagggctttcccttatttaaacaagcttcatttttttatccaaacatttacttagctgattaagcttcacttgtttattttcttcaaagcattcattcaggtgggtactgagtaaactgaaatatcacaccagggaacttcaacaccatccaagtcttaaaggcttcacttgttcacagttggcatttagtgaatgtctaggctactgataatattgtgagtaagttggcagggatcataagaaatgataaaatacagttcttgaaaatgttatggtttgaggaaaagatctatgtttggaattagactgacttggattcaaactctggctgtacctttgggacaaggtgttcagaaactctagcctatgttttttttctgcaaaatgatcctcttttccaggattcctgtagagattcaaagatatgtgaatgtttagaaaaagaatagacttttgatcattgttaattcccttactttccccaattagacttgtaagactgggaagaaagctacacaaaagattgaacaaattatagctgacagaccatagcaaaagatacagggcaaaacttaaaggggaaaactacacattaaattattttaaaccattaaatagcactaacttttgtcagatattacaaccaaacaccactcaaattaaagtaaactgaataaaatgcctgtttttttctgtttactgatgttttcatttgcttcattcatttattggaagatataaaatgtgttagacactgttaggtgctgagtgtataaaaaaatcttattaatacaatttaaacacgcacacacatatatatggttataacaattgatgccatgtatgtactgtttatatgcctatacattattccacagacctggggggagggggatgtagagtcttaccagaaccataggaatcttctcacatcaacatttccttttgaagtttgttcatgaggcaccatccagataatactaccatctgcaatgtggcttgagaagatgttagatttttttattacacataataaggctgtaaagtatttctgtatttaggtagaggtatgtaatacaatatgtatataaaattacatatccaataaaatctggtgttaaataaggactagcttctatgataatatagtctaaaggcttttcatttggtgttatagaaattatgtgaaatatgtttcctggagtagaattattcgcatttcagctctctgacagtggaagaaaagctagagggagaggtgaacaagagagggagcataatggacaaagctttgctggaagccaaaccaccacttcatatgtcaaatctgacaggcctcccattttaggtgtgctgtcattgaagctttcagctgcaccttgcctgtggctaggctattttcaaagattaaaatgcgaaactggaaattaaatgcaacttaattcccaatttaaatttccattatttttgaaaagtaaaagattaaaagaaatgtataattgcaattctggtggaagaggtaattataggaaaggtgggatgtatttcaagtgggggatatagcttactgcagcagagaggaatctaagctatcattcttttgaaattggtctggaaatatgttttcacatggaaaatatactatatttttaggaatttccttgtcatattactgtatccttttctgttagaatataaattctgaattccctattccactgtagatctgcctccgattatattagctcttctgaagttatcaaaaaataatgagatatacaatattccatatatgtcaaagcaattatttttaggttaagtaataaaccaatgacctttaacccggtaatattctgggttgttcataaaaaaactatattcaggtaataatgtctttccacttaagcaactgaaaaaatacacaatacttaacatttggttaattaaatacctactccagacaaaaggattttctgttttcaagttatcttagcaagctgagcaggaagcaatgatatatccaatcagaatatccatggaagctctgctacagtttcaaaaagttctcatcaggcagcttttaaaatgcctactctgaaaatggtccaggttaaagaacaacagcttcctcgtcagatagcagtattgcttggccatgtttcttcctagcacaaaaaagtacctgctcttctctgagtacctacattctaaggactatggcttacataaaacagcatgggttggggcaatttccagcacactgctcactctcgaaaacgtatgatgcaggtgagagtaatgtttttgtttgaatctgctttcactcgtggaagatgaaactacttgcaaagatctgtactttagctattatgagtaacaaaagactcctaaaatattgcacacattgtggggatggagaaccatcatcctgggatttgatggatcctatggtttggctttgtgtccccacccaaatctcattttgaattgtaatccccacaatccccacatgtcaagggagagagaccaggtggaggtaactgaatcatgggagcaatttctcccatgctgttctcctgatagtgagtgagttctcacaagatctgattgttttataaggggctcttcctgcttcactgggcacttcttcctgccacctgtgaagaaggtggcttgctccttctcaccttatgccacgatggtaagtttcctgaggcctccccagccatgctgaactgtgtgtcaattaaacctctttcttttataaattacccagtctcaggcagttctttatagcagtatgaaaatggactaatagagacgtgtctctcagaagtcacagtgatgcttgaacggatccagagctccttcttcaggaaggtcccaactcattctgaagggtctctccaagcccacctctctctgtaaatgggaaaggttttactttgagcactaaaacctgccagaattctcaattttcctaacagtgtgttaataaacacctactcatttagtatccaaaccaggtctgtatttctcaattagagctcaccaggctttcatcataaagtagagcttcaaattgtctgcaatcccactcctatcaaaaacctagaaggaggtaatatttcagagtaatactataaccagatgaccacatctaagaaactgctgaccctacgatgtaaccttctgtccatttttccctttggaaagtctaggatcttttcttataccagcaagttacaagcctggactacactaacttgctttccgcagaagaaaacaccatgagttctgttttcatattaagcacttagtctccatcagacatcaatcgagaaaaaatcattaaaaatcacattttatatttgatgtatatttctcaataatcctatgtattagttcattttcctactgctatgaagaaatacccaagactgggtaatttataagtaaaaagaggcttaatggactcacagtctcacatgactagggaggcctcacaatcatggtggaaggtgaaggggtagcaaaggcatggcttacatggtggcaggcaagagcgtgtgcaggaaaattgccctttataaaaccatcagatctcctgagacttattcactgccataaggacagcacaagtatttagctccctcagcacagaaccatccccgtgattcaattacctcccaccaggtcactcccatgacacatggggattatgggagctacaattcaagatgagatttggatggggacacagccaaaccatatcatcctatttggatgatcaatattatcaaggtatgctcccctgagggggcgtcctttttaccatttaactccaggacaaaagtttatttctttgtaaggacagtgtttatttcttatggtcctattttctcctaagatccagacaccaaaatggccatctatcattgacttaactcctgaattttgcttagagtaacagatttagtgaatctaaatattttctggctgtggaatgttaatttatacatgttcaagttacctttgattcatgtgacagtttgtgccaaaacacactcattatcagaactcagatcattatgttggctcttgttttcgttactaaaggaagaaaaacagtttctcaaaaagaaaattctgatacctaggaagaccattatacctcactcttttctttatctcatcaccacatccaatattataaaagaacttacaaagtaaaaagaaaggtgttctgtagatgtagcgcctggcttgtatggtagcttaaatgaacacagctaaaaatattttatggctagtgtccaaaacagtctggcaccagacaaaataagaatatttaaaattatattttagagttactttaagaggaagggagagagagatgtaggcaggaggaggaggagcaggaggagagggagagagagagagagagagagagagagagagagagagagagaatctggggtttctatggaagggctaagaatatgtagaaaacagtttacaaagaaatatggtccaagaatcgtgtgtacacacacacacacacacacacacacacacacaccccctggaatatttttcagccttaaaaagaagaagatctgtcatttgtcccaacatggatggacctggaggaccttatgctaaatgaaataagccagaccaagaaagaaaaatattgtatgatctcacttatatatggaatctttttttaaaaaaggtcaaatatatacagatagtgaattaaacagtggttaccagggtcagggtagttgtgaggaaatggggcaatgtaggtcataggatacaaatgattaaaatatattaatatattaaaagatataatatacatcatgaggactacagttaataatagtgtgtattcaagatttttgataaatgaatagattatagctgttcttgccacagagtgaaaaatgggtaactgtgaaatgatagatatgataatgttctccacaatggtaactattttacactatatatataaatatctatgcatcttacaccattatgtggtatcccttaaatatatacaataaaatttattttacaaacacatattaggaatgcatattctgatttttaacaatagttaacctcattaatatatttcacactatcatttctagtgtacatgaaaagtagtttattgacattagttgtaaaaaaaaaaaaaatggtcttgagacttttgggtcagagaatgttctggccataaggtaggtttctgcttgcctactagatatcttaacttcgatttcctgaacatcccatcacttcagaatctctcaatcctttctaacatccgcaacattgtttttctttctgcatttcttatattgactgatggatttataattcactttctctgaaaaaccctgcagttatcatatatccctatccattctggctctttattgcccaaatctctaccaaaatcctgtcagcacagcctctgaaatatttctcaaagcatttataatctggctctcatcaacattttcaacactctgttttatcattccactattttacatcatttcattttcatttttaccacaatcactcatccaacaaataagtatttagctccctcagtaattagtattattattattaattataactagatgctgagcatacagaagtgaacatgacagacataatcccagcagggatgtcagactttatgcaagtaatcaaccatgatgaatctcatgagattctgagagagagagagagagattgagagagagagagaaaggggaaccactggtgtccgagttagaaatttgaattagtatctgggtcaccaaaagcttctgtgaagaagtgatatagacttggccacacaaaactaccgtgaaggtggtggaaatttttctatgcagagtaccacatttaaagagctaagcctgagagtgtcagagataaaggaacagaaagaatgtgacagcagattatgtttggaagaaagatgttcaagagaccaagctaaagaggagatggggctagaacctggagggtccttcgggtcctgttgggagttttttctctgcccagaagggctttgtcacgtggttgtcaggaaagagtcatgattagagctttgattcagagacttctttcgctgaagtgtggagaatggttcagagagaagcaaatctgaatggacaaaagaggttattattgtaatcttggcaagaagcgatggtggtcttgactaaaatagttctagtgagaatgtgacaacaaacctgagaaaaatacaggagacgtaattgacgggggttagtgttaagttgaacgattgcagagttgaatttgaggaaagtgtcatatatcattcccagtttctgatgtcatacacctctggagataacactgccatttcttttgaaatgggaaaataataagtgatcagtaagtacgtattggataaaataatgaatggttaaatgcataaggggagaggaaaagagttgcagagaaagagagtaaacgtattttggatgtgttaattttgagatacctttgaaaaatccaagtgaggggttgggtagtcagagaaatgaatgtggatgtcaggacgaaaggtgaccgtgatgaactgtatgtcttcctctaagcacgttatacagcttcatgtcacaagtgactcacttcatgtcacaagtgactcacaaggtcacttgtgacaagcatttgcctggtgcttcatccctaacctccctttctatactcagctaaaatgtcacctacaatacttcttccttgactccaccgtccccactttactgatatgaatacattttaataaaatgatataataatgcttagtttgtaaacctaatgttcctcaagtggtataattatctgatttgtatgtgatcatcaacccaaccatattaggagcaccttgaaggtagaagatttaggttcatgcttaacaccacatctggaccactgtggatttaactttctacaatgattgtattcattaatatattgggtgcccactatattccaagtaatatcctgcacactacgtacaaggaagcataggtcccgtgtgctcatgaaactgtaattttagtaagcagggataggatacaaactgagaaaggaaaacaatttagaaagtgggaaatattatgcacagaattaataaaaaagagaaaaatcttgaaaaagtcttcaatacctcacttggaaggtgattttgaagaagaactgatggacaaactagagtcagccatgtaatgatgtaggggcaaagcattccgggcacaagggacagcttatgcaaagaccttaaaaatgaactagctttgtatgttggagaaggataaagagaactaaggtatctataaggtaattaggaagaggatgagttatttagtcccttagtctttgaagcacattatctcatacttcaattgagtttattcttagtgtcattcttctggatgcaatatttgagataaatgtcttaatgaacgttcacctccctccgtagtaatgcctgagtgtcacaaaaactttttttgtttacatacgtagccatctaatggaaacataaaataggaatcaaaagttgagtttcatgtacaaaaggtaaggactgtacatgtggtcataacaacttcaaaagcacctgaaggtaacctttaaggaagatacaaaggctaggaaatatctaggatccatgaagacagacttacttaaggtcatagtgtgtccagagttggttcccgccggtgggttcgtggtctcgctgacttcaagaacgaagccacggacctctgcggtgactgttacagctcttaaaggtggcacgaacccaaacagcgagcagcagcaagatttattgtgaagagcaaaagaacaaagcttccacaacgtggaaggggacccaagcaggttgccgctgctggcttgggtggccagcttttattcccttactgtcccctcccatgttccatttctgtcctatcagagtgcccttttttcaatcctccccacgattggctacttttagaatcctactgattggtgcattttacagagcgctgattggtgcgttttacaatcctcttgtaagacgggaaggttcctgattggtgcgttttacaatcctcttgtaagacagaaaagttccccaagtccccactcgacccagaaagtccagctggcctcacctctcaatagcattaagaatatagtttcacgagcatatatgaatcaaaacttacatttgccaattttatttgcttgtttatgtgtttccaacatgtcttgtcttagggccaaatgtttccctagagaataactattccaactatcttagttgctgtatttttatgcaaccttcaactctccatactaaaatgtctccagaatagaaaataaatcttttcaaagtttcaaaagaggctctctatatattccccttaaaagtaccaggcagacatatttctaggtttctaacattgcgtgttgccaggaagtatatccaaaccatcacaagttattcatgtaaccaagcacacttattggagtgcttctgcttctgttcttgcttgaaattggaagctccttccaggaaaaaaaaaaaatatctatagaaggggaaaaaagtaattttactttgaaaataaaatatacgtgagcaatagttttattctgtttttaatttaccatagcttccaaagacaacattgttttatagtaggggttagcaagtgttttctgtaatgtaaacgtaaagggccagagagtaaatattttaggctttgttttctatactctgttgcaactattcaactctgctgttagaatgttgaagcagtcatagacaatagagaaatgaagatgtgtcattgtgatccaataaaactttatttacaaaaatggcaatgggctagttacggcttgagggctgcagtttgcagactctcacttcagagctaacagttgttgtcaggagtcacttgtttttggaaacctacaatgaggtactataacaccaaaaagagttatcccttcctttttctctctcactttttgaattatgagaagaattagaaatgtagttaatgataatgtccaaccagtgtaattatacttgttagaaacacagctggaagcctgttgtccagtcttatttctcctctgtgatcctcattttcagaggttgaagtcataagtttgccatgtctactttctgacaggggaattataataatgtggagtcaccttttgtttgtgactttgacaatgcttcattgacttactcaccaattttctaatttttatgaagactttttgccgaaatgtagactcagtcttctctcttgtctactctttctataacaattaacaatgaacttatttacctttttaacatctttttaaaaattttctatacaccttgaaaatgtgaatacaaagtaatgctgcatcatgtatattgccttattcacacatagcctcttatggtatatcatataaaaatggaacaatacagcaacaggttgaatgaacagtaatcaggtaacaggaaaatgagatgtctttaatatttcacttaaaaactcaatttcctaaagcatacatataaatatttggaagtatagttagaagaaaaatatctttaaaatattttaattgattagtcttatttataagataatttttaggaggctggttgcggtggctcacacctgtaatcccagcactttgggaggccgaggtgggcagatcatgaggtcaggaaatcgagaccatcctggctaacacggtgaaactccgtctctactaaaaatacaaaaattagccgtgcatggcagcgcatgcctgtaatcccagctactcgggaggctgaggcaggagaatcacttgaacctgggaggcggaggttgcagtgagccgagatcgcgccactgcactccagcctggtgacagagctagactccgtctcaataataatcataatcataataataatttttaggaagcatcagaaatatataagaaaaagattattttcttaattgctttactaaaaacacctctatgatttttcagtaaaacttgattcttatgtcatgtgtgagtgtgatctgcctctcttgggatactactgtactcatgaggagtgatttttttctccaacgacctctttgtcacgtcaacaggtcacaggaatagtgtaccctaaaaagccacctgccacatgctgctgaaaatgtaaaagtacacacatacacacacacacacacacacacacacacacacacacacaccaaaatcaggtatcacaagctgaaaataaaattgagtccaatttttttttaattgagcagttaatgtccttaaaacaaaatcctatactgcaacaaatacttagccagatcattctgatacctccaaactgtggtgtattccaagatacctctatgatctttgatttgatccacagcttttcagttatcatgcaaataccttcaagttttatctcatttctcagtgcaaactcattaaaaattttcagctgaattcaattttataaacatgttgtgaatgtcctctttatataagcaaggttgtaaggaactggccacataaacagaaaattgaataacatatggtttctggccttagtgatctcatgtgtgagttaggcatatgggcaaaatcagaacactatagagtataagtctaaaatggtagtattttataatagaggatgaagagggtgctgtgggatcataggtgacagatataactcccgttgtgggacttgagaaaggcttcacagtctggaaacatttagttgctattgaacacaaaataagactcactgttgagagaagggagagggagggcatttcaatcaaattaagattctgtggcatattcggaaactgatgtttttaaaaagagtaatgtttattacattcctctacataaattatatttctatgtaatatgaatgacaaatatttaacacaaaatgccttataacatttgaatgaaatccatcatatgacctgttatctatttccatttcctttttgctcatatcattatgaacaatgacctgataaattttttataagactttgctgaattagtaaaggattattaagtttagaatgaacaaagctgaccaatcattcaggcaaatttgaccgttttgttgtcgcttttcttatttctgaaaccatacaattccctgaaatgaataagtacatatttgataacttcctaaattaaggctcaaaacactggtaatctactgggctttcatttgttccttctatttgtctaatcctatctatatttctttatatgagctatgaaaatattagatttattaagttgtcctttatcttaatagagaagaatgtttttctatgacattaagaggaatttgatttttttctttaatgatctacttttaattttggtagagtagcattgataagatcaatattacacattgttaagtatgcattacatgttgataagataaatattacacttaaaatatgtttatcaaatgtatgaatgataaaaacgaattctgaaatgtatgggaaagatcttgaataaaggtctatgtacatttcaaggatgtctacatatgcaaattatcataatataataactattgaatatgattatcttcacatactttctttatttttcatctcttagatgaaattgggtattgttttcttatagctggaacaaagcattacagagaattcttagtgtgatttcattgaaactcactgttatatgagttcaacaaagtttaaattagtccatgacttaatcatcctttataaatcctatcactagtattcggtaaggacaaagtcaattaaaaaattagcaacagaagcattaaaagaaggattaataaatacaaaataagggatgtgatatctttacgtattgctgagatgttagtgctaaggaaaaacttccctgttcataatgtgaggtgggaaaaagaagaactattattgtatatttctcctctctaaaactgcctatctgactgtgtttttctgtgtcagccgtattaacagatgtttaattttactcactttagtatataaggcatcataatgtatgaactatttcaaaggccctatgatggctaattaaataaaaatatattaaatattagctggacaaaataaaatatgtattaattttggaaaaagtagatcaaggttttgcagatcttttcatatcaatatattcatttgctgaataagcttttattgtttaccaatattactagttttatagagatgtagatatcaccacagtatgactaattttatagggacacagatagatagatgttattttattccaatcttatttttacatataacaggtataaatatgcgcttgaaaggagtatatcacttaggagtcagtcagaaaagtaaagatcttctagtctaatacagtggttctcagccaggggtgattctgctgcacgctgagggataaattggcaatttctggagacatttttggttgtgacaattgcaggagtgttactggtattcatttggtagagacagagatattggtagacactgtacaggacacaggaaagtctcttacaacaaagaattattctgtccaaaatgtcagttgtggtgaggttgggaaacactggtctggaagaaggaatttactatgaggaactagttacgaaagtatagagacatttaacaagctgaacaaaggatagtgagatggctcagagattagcaactgtggcatgaagccactactacgtttaggtaaaaataagctaccatttattcttatagtaataataataataattattattattattatttgagatggagtttcgctctgttgcccgggttggagtacaatggtacaatctcgactcacttcaacctctgcctcccagattcaagcgattctcctgcctcagcctcctgaatagctgggattacaggtgtgcaccacccctcccagttaattttttgtatttttggtagaaacggggtttcaccatgttggtcaggctggtctcgaactcctgacctcagatgatccatccacctcagcctcccaaagtgctgggattacaggcatgagccaccacacctggcccactctttcttttttaattattgagaaatataaaaatatgtcaaaagtaacaggtgtggtggagttacagcatgcacataatgggatacagcccattatctaatctcagatggaaactagaaaaaaaagagaagatctttgctaaagcacagattatgtggaaaatcatttagaaaaatagcttatcacaacattaaaattaaatcctttagctgatcatttttccttgctattttttcttttaaaattgagaagacagtgagttttttttctttattgtcattatcttgatgtcaaaaaataatatgcacattataagtgggaaaaaagataagtcgaaatgaaatgaaacaatgcgaggaaaaaaatgtcacaacactcttcaattagaaaaaatgacccccatctttcctccaaatagaaatgacgtaactgaagtagtggaactttctcttccatggcaactctagagaaggggtagatggcatgggattgtggacagatggacacagaaagaggcctcatttattgttattgttaaaacttttacttctagtaatagtgacacctccttcagcatttctttatcaattgtcaatattttttggatcaccagcatcaccttctatatgtatgtctagaaacctcctgttatgaatttacacttctcagagtcaagacagaaatgctgtgaattgggcgataaataaaataccccccttttattgccttgctttgtctcttaaagaaagatgcctgttgggggactatgagaatgctttgtgcttctggacctcaagggacaaatctataataaaaattatgcatagtgatgagaaatatatataatgcaagtttgtagagatcagttaacttatcttgtctaggcaattatttctaaacaatgatttcaaatcattaactataatatagcccattcataccctccatttttgtcaaatccctgtcaccttcaaggacttggccatcccataggctgctctgcttttaatagaggaagatgctgtaactcttggtaccattgccagttatgaatttatccattaatgaacattgcatttaaggcataggtttatctccttctccaggtatgaacctgcaggattcctacctgaagcttaagggagaataaatccacctgggacaatcaaggacagatcaaccaatcagctcaaagcaggtgtgaattacacagtttatttgagtgacaaggtagctaaagcagggataataaaagaagggagtgggttgatgtggacagacgaactatggctttaggaaatttggtagggactgaaacatattttgtgtaatttatgtgggtctaatagcttttgaaacttgtttacaagacctgtgtaagtggtactggcatattcatgcatgagaaaacatcaagggaaaacttaatagttcaaggaggtgacaaagaagagaggaaccaattattttcactagccgtcaaaagcaagaaaataatcagcttgagcccttcggggaaaagataggttaaatattaagtaacagtttgttattattccaagtgttttcttaaagttgctcccatactttcctgttttctctgagggaatttagtttttttgttggtttttttttttttttttttataactgtcattggtcagagcttgatttgatgccagtcaaatttttttaaagagattatgaaaactgcttaaactcttccaaagggaagatgggtcattcttaacatgtgtttcaagaggaagagcataagagcattatatggtaaggctgaaagcagatatcagcgtttaggggccatgaagaggtagagctcacattggtaggatcattgactagaattccagagatcaaaattgtatgttagtctagcattggggaggacttgtagctagtatcttcattctagcttgggagcctaggaatcaggttaggcatcttgcacaggaatgggccgatgggctaaaatctccttgagagagatgattaatccaggacaaaccaagcagtcatgccaatgaattactttaacagggtacttcatatcctcatcctttgggcagcacggtcttcagagatggggcaggccccaggctgcagttgagattctataaactaaggtcaaaaagatgcagcagtgaagaagtcatgcttatcttgtataaatcatgttttcttttctttttaatgaaaatgtacatttaacacattttaaaactaaatattgaccctaaaattccaaccaaaaaatgctacataagtggtatttatttttgaatttccctcatgctcctcccactgtggggacaaggagtggtggtggaagagagatcttttagcaaacctgtgagtagagaattagaaggtaatgggaggaaggtaaaaggaaaacatcatagatggataggctcacaaacattaaaggccttcgtgcctgtccttcatgcctattcatccctctccagtatgtgaatcaatgtacttgttaaatattcattcacctcacatatttagcattaaccgtgtatcagggacgttgttagaccgttggtttacgatgatgtgtaaaatatcatttgtaactcagactaactggaagtgctcaatataataagatgtaatgttatggaacactaagtctgtgctgaagacttatctcctttaatcctaaaacaatcctggtgggtagtctcaatgatcatctccaagtcacagttgaggaaattaaggcttcaagaagttaagaaactggaccaacatcacaaaggtagcatcagagtgacagtttgatttcaaagtgtacttgacttcaaggcccacatttccttgcacgtttaatattgcctttctcaggtaaatataccattaaatgtgatacaactctaagcatttgaattacttacaacgtgcagagttaaaaccagcattatttacactatacttcagctcgtttataagtgaactattattttgtggactaacctatgaaatgtaaccacattgaattcctctgttaggtacaggtttggtgattccagggaatagagtatgactgaatgcacaggtaggggtgaagtgaacccggtcagaaaatttagagagcatcgagcagatcattaagcagctgtctttcaaatgtgcagaacacaactcatttgtaatctagggactatctgtattgattcttcccagggaagttacttatttttatacatatgtggtgtgttctgtccataataccattctacatggtaatgctcaactttattatttaaaaaaactgctaataatgaggtttttctttgtatcacagaagcagcaggagcaagttttctttttccttcccagtttttttaagtactgccaaggaatgtgattttgtcagacttgtatttcctattaagccaatctgcatgactgttccttctactagctttacctgttcactcatttattaattcatcaaatatttgtagagtgactattgtgtgccacatactaatataggcacaaggataaccaaaaacagacaaacgctgtcctttcaaggagctcatatagtaatgggaagttaggaaaggagaaaataaatatgtggtatttcaaatggaagtattaaagtgttaagaagaaaagagaaactaacaagatagggaaaaagtgacaggaacatgatgttttattttttatttatatatattttttgagacagggtctcattctgttgcctaagctggtgtgcagtgacgtgatcatggctcactgcagccttgacctccctgggctcagatgatcctcccacatcagcctcccaagtagccaggtctacaggcatgtaccacgatacccagctaacacgttttcttttcttatagagacagagtctcactgtgttgcccaggctgttcttgaactccggggctcaagcagtccacccacatctacctcctaaggtgctggaattacaggcatgaaccaccatgcccagccgaaattgatgttttatatatggcagtctgggcagacctctttgatgtgatatttgaacagaaatctcaagagagggagtgtattagcccgttttcataccgctagaaagaactgcccgagattgggtaatttataaaggaaagaggtttaattgactcacagttcaatatggctggggaggcctcaggaaacttaaaatcatggcagaaaatgaaggggaagcgaggcaccttcttcacaaggtggcaggaaggagaagtactgaggaaagggggaagagacccttataaaaccatcagattttgggagaattcactcactatcatgagaacagcatgggggaagccaaccccatgattcaattacctccacatagcctctcctttgacacctggggattatggggattataaggattacaattcaagatgagatttgggtggggacacaaagcccaaacatatcattttgctcctggcccctcccaaatctcatgtccctttcacatttcaaaaccaatcatgccttgacaacagtactccaaagtattaattcatttcagcattaacccaaaagtccaagtccaaagtctcatctgagacaaggcaagtctgttctgcctgtgagcctgtaaaatcaaaagcaagttagttacttcctagataaaatggaagcacaggcactgggtaaatatacccattacaaatgggagaaattagccaaaatgaaggggctacaggccccaagccagtccaaaatctatcagggcagtcaaatcttacagctctgaagttgtctcctttgactccatttctcacatccaggtaacactgatgcaagaggtgggttcccatggtcttggtaagctccacccctgtgggtttgcagggtagagcccctctcctggctgcttttacaggctggcattgagtgtctgcagcttttccaggcacgtggtgcaagctgttgatcgctctaccattgtggggtctggtggacagtggccctcttctcatagctccgctaggcagtgccccagtggggactctgtgttggggctccaaccccacatttcccttccacactgtcctagccgaggttctccatgaggtcttcattcctgcagcagacttctgcctggacatccaggagtttccatacatcctctgaaatctaggcagaggttcccaaacttcaattcttgaattctgtgtatccacagactcaacaccacgtggcagttgccaaagcttgggacttgctccctctgaagcaatggtccgaactgtaccttggccccttttatccatggctggagtggctgggacacaaggcaccaagtcctgatgccgcacacagtggtggggttgggggggggacctggtccacgaaaccatttttgcctcctagacctctgggtctgtgatgggaggagccgcaatgaaggtctctgacttgccctggagacattttccccattgtcttgcctattaacattgggctccttgttaaatatgcaaatttctacagccagcctctccagaaaatgggtttttcttttctactgcattgtcaggttgcaaatttttcaaacttttatgctctgtgacctcttgaatgctttgctgcttagaaatttcttctgtcagataccttaaatcatctctcaagttcaaagttccacagatctctaggtcagggtcaaaatgatgccagtctctttgttagtcatagcaagaatgacctttactccagttaccaataagttcttcatctccatctgagaccacctctgcctggacttcagtgttcgtatcactatcagcattttggtcaaaaccattcaacaagtctctaggaagttccaaacttttccacattttcctgtcttcttctgagcctcctaactgttccaacccctgcctattacccagttctaaagttgcttccacattttcaagtatctttatagcagtacctcactacctcagtaccactggtcttaactcctgcgctcaagcgatctgcttgcctccacccctaaagtgctgaaattacagacatggtccattgtgccgagccaaaattgatattttatgtatgacactctgggcagacctctatgaggtgacatttgaacagaaatctcaaggaaggggagaaattatccatttacatatttggggaaagagcattccaggtagaagaaacagaaaatccgtagtcttgaggaatgccgtgtatatgcagtatttttcaaacttgttattttgaaatacatatacacttacaggaagttgcaaaagtattaagaaagatcatgagtacccttcactcatcttcagctaatggttacatcttacataattatatgtaatatcaaagccaggaaaccaggaaattgatgttgatacaatctatgctttattcagatctcacatcttacatagctatgcacaatataaaaaccaggaaattgatattaacacaatctatgccttattcagatctcaccagcttttacatgcacttatctgtgtctgtcattctatgcaattttataccatgtttagagtcatataacaactacccctattttgatacatggtactgaatagttccagcgtcacaaaggaactatctcaagccaccctttaattgtcacacccatccaatctcccattctacttcctgaatcactagcaacccctaatctgttctccatctctatgattttgtcttttcaagggagttttctaagtaaactcatttggggaaagaaaggagatgaattgttctagccacggagtggagaacagagagtaagagtacctattgaagcagagggagtcattgcaataattcaaatgagaaataatggtgattctaaaccaggaagctttcagtgaaaacaatgagaggtacatggattctgggtatttttggaaggtagcactaccaggtttgctgatgaatggggtatggggtgggaaagaaagagaagagcccaggatgagtccaaggtggataaggtgaatagaattgagaaaatggtagaaggatcaagttagatggtagaggggtaaaggtggaagcaataattttgttttggaattgttaggtttgaaatcttgttagacatcccagtaaagtcacaaagagtgcagttggatgaaagtatgggattcagggaagaagtatgtgctagagatgcagatttgagagtcatctgtgtggaggtattattcaaattcaagtccccttggaatgaatggctattcaggcagggtcttcataaaaatgcttgttgcatgcctgtaatcccagcactttgggagtctgaggtgggtggaacacttgaggtcaggagtttgagaccagcctgatcaacttggtgaacccccatctctactaaaaatacaaaaaaaaaaaaagttagctgggcgttgtggcacatgcctgtaatcccaggtacttgggaggctgaggcaggagaattgagccaagattgtgccattgcattccagcctgggcaacaagagcaaaactccgcctcaaaaaaaaaaaaaaaaaaaaaaaaaagcttgttgcttcaaattcatgtcagtctgtaaaattatctgggaaggcagtacaaaaactgtcactttgactacgatgtttctggtgacccatcttcattgatcagtatggaaaaggcatgtctctgaaaatctctgagagtctttgatacagcaagaacataaggataaatcattcttctatgttcatggttgtagaggatcttgaatgtttaatggcagaatagccagatcacactctggcacttctgtatgagaggctgagggatgttactgattcaccccgagaaatatttactactaaggggacagaggcaaaggggatacaagacttcaccctgagctgtagcgctccctccttccctatcctgctttcattcttcacattgttttccttctttcttttttattattatactttaagttctgggatacacgtgcagaatgtacaggtttgttacataggtatacatttgccacggtggtttgctgcacccatcaacccgtcatctaggttttaagccccacatgcattaggtatttgtcctaatgctctccctcaccttttccctgtgtccacattgttttctttctttttgaagcctctcattcactaggtttcaatcctgccttgctagtgttctaactctaaggcctaggcaagttatttcaccgaacttagcctcagtgtcctcatctgcaaaatggatagttttatgatatcttcagcccttaaagtcaatggttctgacagctagggtgtactatcttcttggatatcagtcatctcaagcaagccctccttttttggaccttcttttcacacacttcacataccttagagaacataatacacatcctctttactcagggcttattctttataacaggcttcctaattcaattaactcaacttttcaaaaatattagtgactactgtgatgtaaataaatttgcattttataggggtcttagtaacccagaagggagtggggaaaattaatatatattgagagtttattaagtgctaggtactgtaaatattttcttgtatttaatcctccgagtaattctacaacaaagatattatcattgctattatgtaaataaaagaacaaagtagaaagaaacccacggtcttgtataagctcccctagttggtgggtattgaagggagtatttcaatctttggtagcttctgagtttttgttctctcagggaatctgccagatgtccagggcacctgccaaaccctatgaggctataagaaaaccattaagggtcttagattacccagctttttgggagttagaattctgaatgaaatttagtgttcctgcagctacaaaggaattgagttagggaagtgatgactttatctttagctacattggttattttccttataataatcctggcttggtagattagaggcagcccgagtaacccagaatcgctaaaatagaagtgcgagctcattgcccgctgtccttcactatgtttgcatataggaagcaagaataaaacaagcataaaataggctaactagcttgtcagagctcttcacaccaagtctttgtgagttccaataagacactgactattattaaaaagacagagactccacataagtaggaatttattgttttccttttcagtcaccaaaggacaatcctctgcataggttagcaaaaaatggtactgatcctataatctctaatattaaagtttagatttggcaagctgtacatcttatgttgttcattaacaaaaaacaatattgattggtatcttgtactataacttgtactgtgggtcaaattccaatacagcaaataccattgcaataacaattctacaaaactacatcaaaaaaacctttcatgtttgagccaacagcctgatagtgctaaggactttgagtacagtatgctagaagattcttaacagttatttgtcctggacaacaaaggttgactccattaaaaacatagccatcagtgtgggattatttccaaatcaagcttttggaaaagtcaaatgaaagtttgcaagcaggtggggcatggtggttcatgcctgtaatctcagcactttgggatgctgaggcaggcggatcacctgaggtcaggagttcgagaccagcctggccaacgtggtaaaacccccatctctactaaaaatacaaaaattagctggcttttgtggtgcatgcttgtaatcccagctactcaggagcctgaggcacgagaatcacttgaactcgggaggcagaggttgcagtgagccgggatcatgccactgcactccagcccacatgacagagtgagaccctgtcttcaaaaaagcaaaaaacaaacacgcaaacaaaaaaaaaaaaaaccaaagttggaatgcaataaatgttcattgaatgaatactgaatagggagtttcagctaatccactcaaaatagtgctgaatttccagctctaaggtcaatgcttggcatatatatcctgaaggaatgaatggacacagagtaattttttttctaaaatgcaaattcaattatgtcacttcccttcttaaaatccttcagtagcttcccgtagcctccagcatattattttgaatagtgcttctcaaactttgatgtgcatcagaatcacctggggattttcttaattaactgatgctgattcagtaggtctggggtattgtctgagattctgcatttctagcaagtgctcagggttatagcaatgattttggcctgcagaccatactttgggtagcaaagacataagccacttaacttgacataaaagactgtttagacccttagtttctctctcgctctttccccattttgagcttttgctccggttcatgtttttccctgaaaataccgtgatcttacattgtctgtctggatgctgaattttccctaattctgggcctccatgtagttttaggtttgacatcacaaccaccaaaagatttccccttctcccttaatcttggttaatgtcactctcatgtattatactgttaatgaagcattgaggacataaaacttatcaaatattttatcacaatcaatgatggcaccagtgataacatccaaatgcctgggtgagtaaataagaggagaataggggacttgttgttaaactaagtttgcagagaaaaaatgtactgattataattaaattggatgtttatttgttatgacaaaaaaggagctagagtcttttaatccaccccttggcaccactgcttatctccttgtaacatacgtttgattcccatgtctatttcttccatatgggaaatttcagctccctaaacatcaccaatacaacctgttgataagacaaagttaaatttattgcttactatggtaagaaagaccacagcctggacaaagctttggtagtatttcataaggagaaaggtgaggttggatttcattgggagtatgaagcttggtttaagattggtctttcactgtgggggcacaattaggattgggtaaggatcatggtattacaacttagtttggtggaaacagcacagtgaagatttctagccaagaggctcagagactattaaggtgtgaactctattgatgttttttgttgaagagttgatgggagtttggggaagttactttagtgaacagtcaaattatttgcctggccaagagttatctgtaataggaaagttatgctaatgaagacaatggaaaggtaaaccatgttaatgtcgacagccagctatgtgagcataaggggtaggtagctttggtcctccatgtccaaactgtttgtagtggtaagtgatcttcattctcacatagattgaaagcttcctgaggacagggcaatgtctttgtaaactttaaaatatctatgtcctgcacatcacctgccgtagacaagcatctagtaattgacggttgggtagatactgagggaaaacatgcaccaaataaaaatggcaataggacacaaattcactatcatttggaagaataacagtgttttccactgatatttgctacacacagtggggtccacagagcagcagtaccacttgggagcttattggaaatggagactctcaggcaccaccgcaggtccaatgaattaaactctgctttttttaaggtcatttgtattcaattattatttttttcttttttctttactttcgatgcatttttctttatttgtttttgagatggggtcttgctattttgccgagtctggtcacaaactcctgagctcaaatgatcctcccacctcagcctcctaagtagctgggatcacagatgtgagccaccacacctggcttgtatcacattaaattttgaggagcagtgctttaatatctattccattctcatcacttgatgaggtattattaattccacttatggatgtggaagttgaagccagaaagtttaaatgacttgtacaaggtcaaacagcttacaggtagttgagccaagaggctctcaagtcttctgcctccacaaacccctgttcagctgctgccctacaatggaataaaatatactaatcccagagggacaaatatgctaaaaatctcaatattatacactttggaaggtgcaggtgcattatctttcaattctaatttctctttcaagttttctgatgcataaaaatatgaacagcaggtctgagcaatgtttagatgccgtgctttgatccttttgccattcaagatgtttgatttgcattctgccaaggaatgtctggtaacctccatgatgcagaccacaccattagtcaagagagagctgacgtaccttcatctgagagctggctggctgtgagctgctcagagggaaaggatttctatttacaaattgtatcgattatttataaataaaagttccccttgctttcttcagttgtaaaatctgcagttagagagtcgggaagaagatcaaaactgcatacatttgcatctgccaagcctgataactagttccagaattacagaaatggtgctgaaatagcacctcaagtaccaggctctatcaaatttaatctatccataaggcaactgccaattatattttagagaaaaaatgtagactgaaaagatagacaatccaagtagcaactcctgtaaaattatatgcccataggagcaatcttgaagatataaatattggtatgtttctccttcatttatcatttatctgatcatttgacaagtatttattgaatgcctgttaagggtgtagatatatgtggtgaggctgcaggtgtaagtaggtctttctgaggatatgcatgaagttgatgttcataacttggagatgtgtgtatacagactgaggattccttcagtggatattaagaagtggagtaataggcagtaaagaatacactagtcagttgtggtacataaacacgtcagcaccacttaggtattaacttcctgttttgttttgtgtgtgcttaattacgctgtttattaaacaagcacatcataatctgcagatattgtcataaacagcacaataaagcctgccacatcagaatgtcatctatcaaattaggtgtgttcctcagctgtcccgataggcacacacctgtgcctgtaaataggcgcttggcggagattgcttccaggtgtggatctgttgggcgaccttgggatgtagggcactttggaaccttttcctctagcttcaggaattaacctctgggcttggttccatgccagcttgcattttgctttgggacagtaacatgtaaagaatatgcctgtgaatttagggttactgagaagtcctcatagaagaagtaaaatttccttgaggaatgggagtcttttattcaatccaggtttaatgcaaggcttggtgaacagctccagaaggttaataattgcgtgcgtgtgtgtgtgtgtgtgtgtgtgtgtgtgtgtgtgtatccttttgtcattcaaaagtatacgtatacacacacacctgtacagctgatgataaatatacattgtatcaatgagttcaaatgaagtgtgctattcattcactgaggaatgggctattataatgaactattatgatattagaaattgtcagggcaataagcaaataatacatacggttttcaacaaactttctaagtattgttatcagtgggtttgcttaaatctttttttacaaatttatttatttttttgagacgaagtctcgctctgtcgccaggctggagtgcagtggtgcaatctcggctcactgcaaccactgcctcccgggttcaaaagattctcctacctcagcctcccgagtagctgagattacaggtgtgcgtcaccatgcccatctaatttttgtatttttagtagagacgggttttcaccatgttggccaggacagtctcgatctcttgaccttgtgatccatctgcctcagcctcccaaagtgctgggtttacaggcgtgagccaccgtgcccaggcaatagccccattgctcagtgaatgaatagcacactttattttaactcattgatataatgtatatttatcatcagctatacaggtgtgtgtgtgtgtgtgtgtgtgtgtgtgtgtgtgtgtgtgtgttgaatgacaaaaggatacacacacacactcttattaaccctctggagctgttcagcaaaccttgcattttttactttcattacagtgtgtaaataatttagcaaattctaatttgaacctgatatcaattgagcatttaatatttagccaaatatttatcaagtgctgactgtgttctagatgctggggctgcaatttcgaaacagaccattgaggccctcatggagctcacaataaatgatcttccttaaagtatcaggtctctggtttgttaccgtattttttaaattgttaaggaaagaaaaaggccctatctttttgtagacaaacatgccctaagtgcttccagaaataatctccatcaggtaatgcagactgtgtgtggagtgaaattgagtccaatccatgatccagcagagtttcagcccaggatttctttagagcctttgctacacacaaagttggctgatgtgccattcagcatcccagcagctctttctcttcacactagcaatggcaaagctttgtgcggaggcattgctggctgctctgaactaaaagcatccgtggggaccgaaagaggtttttgcacaccttattaaggtaggcaagtgtgtctgagtgtgtgtgtgcctaaaagctggaagacatctgttgagaggaaagtgctcttctgtgggtctggcagcttttctgtaagtcttctattctgatgcaggagcgtgtgagcagtgggtgggaggagatgctttggtacttggaatgctgaggtccggattaagtggtattgtaatagctagttagaggcagaataaaaagctgggaatcaaagcatttaaaaatgcatccttccattatttgctctcaagttaaaccatattcattctaggggaaattaaaaaaaaaaaaaaaacacagcaagggcaagtagcccaaatctgtaaggtctttgagcttctctgttcgtccagcttttgaagtcttcctacagccaatttgtttggctcctctggagggggcaattcatatccacttccctctcctggagcatttctttcttctatactccatcagggaacaatagagtttaacagtaacaggcaattttttttttttttcaaagcttgtgccctcttctgcgtttaaaggtgttttttaagagactcctgctaggggaatcttggcgcctgtgtgttaagacggcaattaacttttagtatcagtgcttacattaaattttctctctttctgctttactaaagcagtcattaaaattcagtgtgagtaccatgaaactttatcataaaaccctgctttgcttagagaaccttgattgttttctgaaagcagccttctcagtttatatatacatagctgccttccttggaatatcaaattgctttgtgtcacattaagaaacactaggttgaacctctatactgtgttttatctgagaaaaatactactgcaaaaagtttgatttgttcaagttttaggatgaaaatttctttgtaacaagttatttgagttgcatactatgtcatcgtatatctctttagttcaagtaattttgcaattaacatacggttatgtaaagaagataatgatttattttttatttatatttttaaaagttattaagtgaggttttcctttcagtaagagtttagaaaaaatagccagaacaagtaactggacttggaagataaagatacctttgcacttctaaattttacctttgtacacttcggttgtgatttaatcattgaaatgcctctgctttgaagtaaatgcatcacttatggtgtatgctgtgttttaataaagggaaaacagttatgggttctctgttgcacatttgaatgttgttattttttgctgtatttaataacctcttttttctcttgtgaggtttactttggaaatgaggcatgttcaaaaataggctgacattcagcttctatgttttaaatttaaatgctgtctgtgttttatcacatctggaatgtgtggggagaaaagataccaagttttattatttagatttaattgtagaattgcagattgatatttttcaatgcattttcattatagtttctgccatggaggcagcgtgagggctttcaggaagatggagtggtgtaattaccaggtgcgcacgttcattaatccttcctggctagagaaagcttcaagttcttctccagtggcccattcgtaaagctataaatatctaaattgtgtcagccaagaagtcacacagaatggtggctctttttgagttcaatttcatgcactgttgctttggtcttgtgaggaaagctctgaattccttaggatagtcttggttgtgaagttccaaaaacaaaatatcaaatcattaaggatttaatttaaaatacatactcttctttcacaaactagatgattgcagtaatgtggattataaatttttttttttgctttatttctttagagctcctctttttattttgtatgatcaagattatagctgagattttggtgatttttttaaaaagatttatggcttatggtccatcagtctctccactacttcaaacctgtgtacccctgtatattatctgcagtactggaatgtttgcattgtatgtggaagctatatacgatttggtaaaaaataacacttaaaggtcttcgctaagagtgcttatttaatcattaaatatcccttaataaaaataattccagagatattgtctgtgtacaaacttaaaaaaagagaaatataaaatactgtgatgtgaataaaatgtatagcaatacactccaataataccattcttatgttttcccttgttctcaactgaaataactaagctaatagagacgtcagtaaggaatgtgttgtttcttcataatacaactacaaactcatctgataagaacaacctgagagtgaacgttaactttcctcattagaaagattcaatttaacacatatatacaaatacatttttaagataatgatatttgcagagtttttgtattctatggagtaaaggagaattatcacatattcaaagtaaaggtataaaatacatcttaatgttttacttaaattttaaagggtccaaaatatactaaaattgtttttctaattctttcctatgtttaaacgtgccagagtcattggaaataggacattctttttcttaagaagattttgcccaaaatatttaaaactattttcttttcccttgattttacaatttcaatattcatggatttttctactttaaaaataacagtagtttttatgatcttaaaacaaatgtttaagggcactttcgctctctggagactataccatccacatatttattatcagcaaaagaaagggcagggcatacttttatttgaagttgagtataaaaatgtgtctgtgtgtgagtgttattaaaaagataagtgaagagacaaatatagaatccaggaacattttcagcctggcttttactctctctaaaaatctaatgaaacccttgagcatctcttatctcaaggtacattaggaactgtccaacactatgatccgatgggagatcagtatattcatataaagaagaaaatttgttgttagtgaaagtcaagtcttttaaaaaaataatagttacagcatttgcaatatacaagcataatagatttactcaacgcccaccccccatctttaaaaaatcaatttccgacagttgtctactttaaaattgaacatatttgctacctggagggaacattgtaatgtagcccatatgtggtatgcatcctgaagaaaacctgaaattatagaggaagttatcctgccttctttcttctgttgaatgagttaaaatatattaacaatttgcctttcactttgtatttatcattttgtatctttgcatatttacatatacattcatgtgtacaagggcatatatactcacaggtcagggctatttaaacagctatttatttgaatatgccagggaaaatctccaagatataaagaagcagttattagatactatgtcagtatagaattaacagccatcttttttaagatggaagagaaaattaattaattacatacaatttctaacctcaagacattttctttctggagacaaggaatactgaggtgctcacgatagtgaagactcaacaagaccctaataaaatagatgaggataagtaaaactacaatagccaataaaaaacaaaaaacaataaaccatgtttcgctggcatgttggtgagtatctctgtaatatctgtcaataagggtctctgtagatttggagtaatgttcaggaactacctgtactagagaagacagtggagaggactccagtggctaaattctgctgcctttgcttccagaaatgtaaataataaggaggtattgtggcatttcctggaagcagtagtcttgtttcatggtctgactgtataagaatgcctagagaaacataacctcagctgactaaactcccttgatgattgtcactttgtcactgaactctgaccataccttttgcctccagaggcaaaagacgggtgaggaagtgatctcctcatctggtttttaaacaagtatataactagagaactggattatctcctaaacccactcttgtccctggaaaaaggggagtcatcctatccgtttcttagccaatttatgtatactcttagtttgagagcatgagaaggaaaactattttcttttcttaccttggctgggtttttaagaatttatttttagtttaatcaaaataatattttaaaaggtagtaagcctctcataagcagtttgatctgttctaaaataacttcaatttttctttttttaaactttcttttatcttacacacaaagtataatagtaatatgtactcactagaacaaatgaaacaggatggagtcacatagagaaatatatcatattctccctatcccctcccttaatattaacatttaggtgtcatgtgcttctccattaattttcattgcaaaggcctaaattttcttccaagagtgaggagtagcagcacggtagtttggacctgatatagctctctttccctagccttttgcttaagtgctttcctaggggctgactttacttacctaaagatgtttcaagcaagggctcacatttttggtagcagaagacacttactgattgctctcactaataattttgaaaggaatgtcaaaatctgggaggatcatgaaagaaatatcagaaatttcctttcagctgccattctccttaatactgttatcaataaattcagcatctcatatgtgatagcaaaaaaggtgctgccttttgttcttgcatcctgaggttcttacctaataccatggtagcaataaagatggtgagaaaattgcttcttctatggtgttcaggtcctgaacgagcaccctcacctccacagacggtggcaggtattcaagcattttacagactttggagttaaatatagcagtgttattctaatttaggtatgccaccaccagcggcaccggcaactgcaataggaaaaatgattggcaatgccagctatctgatgttttcatgtgccaggtgctgtcagttcttcacagtattacattccatcctcacaacaagagagtgccagtgagtgttgctgtgtgccagtgcccaggctaagggctttgaacacattaccctgttttatcctcataactttccacgttatttttattcctgaatgaagaaacaagttctctgtagagatgctgtcattgatccactcatatcctttcacatccgtttaacattttccctgctgtgcttttactcccaacaactagctccctaatcgctctgttggagggtggccttgaggctgccagagcctatttggtctgtgtaaagagagagatggatctatcctggaatttatgtccctgtgtgtgggaagcccttaatcaatgactgctggttgcagacacataaatacgtgagctttcttgttcccaactgagaaattcagaagtgtgaatggcactgccaccctgggcttttatgccatatatgtgtttggtctgtttcccttcccaatctcacttcattttcccttaccagtgtttcttgaaaacacatcccattagatcatttttgcatgaagcttcatctcagaacctccatttagggaacccaaactaagatattctctaaaatagaaactttattgataaagtttccaaactgtcttagtagatggccaatataagaccaagccaaatctttctgggtccaaattccctgtctttaattaatagactccattacaacacattcttcaatctttagtcagcaaacacttaccacgtgcctattttatggcatattatatttataccatagttaggatattatggttcatgaatattttatatctgtacacctgaaattctattgacctctctgggccacagttttgcatctgtaaaatcagcacaataatgctacttatctcatagagtagacttaaaaacgaatgaaatgatatatgccaagtgttgagaatcacaattggcaattactcatgctcattaaatattagctgtttttatgagtattgtttcattttcggtgcataatatcctatgcaaagaacaaaaggtattggtataggcattgaaacttgaagcatagaagaaaaagttaattaaccggtgccccactagatgcctctaactgctggctccgtgtatccctttagccttggctcgtcacgagaaaaccttggagacatttctgctggactcagcagatcaatttaagaaagatgaatgacatttttcttgaaatgtattcagtcatagctgcctttttctactttcatattttggagttcttagaaaaaattaaggactcctttttttaaagaaaatggtataaaagaaaatgcatatcactttgtcactttattattgtaacctcatcaaagtattcagtgtaaagacagtagccaagtgaactcttcttgtaatgctcggaaaccattttagcaatggtaaaattgctgcaatttatattcgtcaaattgcatgatttgacttattttagaaaagttattaacttctgaagagaatgcttcagaagcatttaaatgagtacaagttatcaccagtgatatacataaatttcatttcaaaatatacttctagaaactgtacttagttagctatagtatttgtacaaggattaattcctatttcattttgtaggaatttatttatgaatgtctatggcctgccagtgtaaagcagacttagagcatcatcttttacaataatctttttttttttaatcaaaggggagatattctggtaaaacaaaacaaaacaaaaacaatagtttattctgcatttttattaagtccctctgtaagtcatccctgaaatgggatatgtagagtcttatatttatttatttctcagaagcttattggaggtgatatgaaggattttaagaccctactaactaacaaaacaacaatttaaaattaattttcaaaataccttaacaaatcttattctccttattttcaaattctttaacaatgtttttcttattactaacataatatcttctgatgtagtcataataatatctaaaatgacaggtctaagtaacttacatggattaattgagtcttctaaatagtaaggtagatggcactattacttctatatgagaaatgaggaagtagaggtataaataagaaattttttggccgggtgcggtggctcacgcctgtaatcccagcactttgggaggccgaggcgggctgatcacgaggtcaggagatcgagaccatcctggcgaacacggtgaaaccccgtctctactaaaaatataaaaaattagcctggcgtggtagtgggtgcctgtagtcccagctactcgggaggctgaggcaggagaatggcgtgaacccgggaggtggaggttgcagtgagccgagatcgcgccactgcactccagcctgggtgacagagcgagactccatctcaaaaaaaaaaaaaaaaaagaagaaatttttttgagtgtatacagttagaaaatggcaaaatgggaattcagacccaaacagtaagactcaaggatacctttcttatcagtatgctaatatgaaaacctaagcatactagaaaatctaagtgccagttggaaaccagaattaacattttggtgtgtaactttctggctgctttttctatgctaacaaacatatatgacatacaaaaatacacacatacacaaattcctgttcactacttcttttatgttaacatcacaatgtaccgtacacagctgtattattttatatttgatttcatattttttctaaagtcagtgtatttgtcaaatatcaacttatctatttaataggaatatgggatgatctttgcttatacatacatacatatgtatataaaaacaaaatcaagtattttaagcgttcaccagaagtcatatgtcaatcagtaaagtatataattttttgctgccaatgacatatatcataaaaacgctacctatcatagaatgaaaatgaaacacagcaatattgggacacctattctcaagcaacagctttgtgatttattagctatctcacatgaaataactcattaacttggtattccaagcagcaaaagaaggatcacttaggtcacttgcaaaataatacaaagctaggtttaggggtgggttgcgcttggtgggatgtagatgaaaccatatgggcccttgagtttataattgctgggatctgcatggtgggtatatggatgtttattacagtatgctagtgagttaagaaagaagaggaattattattgacttacatcatagagtttatgcaaaaattaaacgataatttatttttaaactctagaggtataggtaccatcatgaagggacccacagaactgatgtagccagtaattattggagctggaacagatactctgctgtcagttgttctggttttgtggtcattgttcttgcctttgcaagttaccaactctaagaccttgggcaatactttaagtcttggttgtctcatctgtaaaatggggagagcagtaagtgtcttaaaggtttattctcatgttatatgacttacggtatgtaaaacatctgcgtttagacacatagagggtgcttaatggatgattgctctcattattaggctacatctaatctatgaatttaaaaactgtatagaaatatgtgacagattctttaagagccaaataccaactacagtgaaaaatacttaacacttgctgagctcttagtatgtgtcaggcttaactaccttaatgctcatagcaatcctataagataggtactcttgttatcctattttatatcttctaaaattgaagcaagggaagttaaataataggacaaagatcatacgctatctatccatatatacccatctggctgtctacctgtctccttccatccatccatccacttattcatctacccatccatccactcagttacttctctctctcccaccatccctttccctttccctctccctctccctgtctctgtcactctcctttacttatctatctatcgatggatcggtttatctatcatctatctatctctatcatctatgtatagttgttaataacactaacattttataaattacaagactgaaaaatgttttcattaacttatggtaacaaaagaccacattgtgaataaaaaaagcagtaaacacaggtctctgcacatatgaaagagatgtcctaaacaggaagagatgtcctaaacagtagggatacatagtatcatacaatcaaaacatggcagccctataaaacttacaaagcaatttcatgtaagttatttcatttgactcttaccacaatctatgaggttactatttttatttttctcattttacaggttaaatttaatatggcttccaataaaaaattagtatggttaataaatatcttgacgtcttgctcctataatcctaccgatagtttacagtaattagtaaaataaaataataggaaaaatacctttgatactagtattaaattataatcatatcattaggtaatttcaatttgtgattttcaagaatctgtaatatggtagcttcttcctactgacatgtttgaattcattttaaggcttataattcacaagtaatctatatattatctaaaatgtaaatgcacattcacatggagataataaattagcgtgaaatggctgtattttgctctctataatttttaacatacaggaaatcactgttgtctcaaaaatcaaggaaatatagtatttgaggtgaacttattctttctactattaacacattttaatatagttctctcacagtgcaacagagcaagaagctttcagacacatttgctgctgcaaggagcatgctgtgctgaacttaaaacaccttccctttcaaactccttgggactgtttttttccaagagacttcaaatgcactaaatttagcatccgttggaggcacacccaggcatattatagtgaaagccccaataactgaatgtgttaccactattcacaatgtttatgtgtgtatatgccttatctatgatgtattgcaaattacaaaaattgtgttattattcacagtaacaaaaacacttccagcaaatttctaacagtgatctcttttgaaataacttacatacatgtgtcatgggtcttaaactttgtcacttttatgtttccatcatgttgttttagccagtgagggttttgtttggttttcatttatgattatatactttcaaaaaatagatttcaaagtgtgaatttgattgattgattgactgattcattgagacggtgtttcactcttgttgcccaggctggggtgcaatggtgcgatctcggctcaccacaacctctaccacccaggttcaagcgattctcctgcctcagcctccctagtagctgggattacagatgtgcaccaccacgcctggctaattttttgtatttttagtagagacaggggttcaccatgttggccaggctggtctcgaactcctgacctcaggtgatccaccctcctcagcttcccaaagcactggaattccagacgtgagccaccgcgcccagcccgtgaattttatttttgaaagacaagaatgtccttgcctaattgcataatagtttaacatcatgaagactaaatatgctttttagccatgacaattttatttattattgttttcatttttaattttctcaaagatcctcatcagtgtactctttttggtcttccttataagcgtattttaacaggacataataataagataaatcccaactttttaaagttgtatccgtatgtattactttaaagtgctattaatataaacgaattagaggcaacttttattcaatcagattttaagtaattttaccaaaaatatggccttgataatgtctctgtaacaggttctctgtaatatacatgctgaggattggtttgtctttgcttttgatactattttaattagaaaagtaatggggaatccagacccttctcatttaataatccagagaaaaatcagtccatgttctaatagtttaaatttttctactaaaacccatgtgagaatccatatgagtggaatggagaggagttcagcttcaaagttggcagatttgagatgattctatggcaacagaaatgtgcttgagggaaatcagttgcggcatcttctataattgtgtcacctagattttgccttaggaatttctagatttccatagaacattgtgacctcaaatgctttatcttaataaagaaataaaagcagattagaagaattatttgcctacagtttgtgggagatgggcaagtcttaagagtttattaggtacccagaacgaaacatattttcttgggcctcataatcacattgaaatacaaggatttagttatacacagtgaccagttagtgaatgacagtcttcagtatctagtagacagtaaacatataaagatgtatttgtggccgggcacggtggctcacgcctgtaatcccagcactttgggaggccgaggcgggcggatcacgaggtcaggagaccgagaccatcctggctaacacggtgaaacctcgtctctactaaaaaatacaaaaaaaaaaaaattagccatgcgtggtggcgggcgcctgtggtcccagctactcgggaggttaaggcaggagaatggcgtgaacccgggaggcggagcttgcagtgagcagaggtcaggccactgcactccagcctgggcgacagagggagactccatctcaaaaagaaaaaaaaaaaaaatgtatttttacttttaactacagcgagagaccctggcagcctacagcatacaattagtgttcattatttagattgcatggatttaatgtgaggggtcaattacttgtctaaccagtgagcctagcctcttgctcaatactgcctgcttcatgagggtgaactgtgctggagaaatatattacaggattatctgcagattttttttaaatgagtggttaagtcaaaagttcttgtgaaaattcagagtaataaattattatgaagttgtgtaactaggtaaaggatagtttcttttacacgggtaaagattaacatgaggaggaaaactttagcaatggcatttaattccattcaatatatttatattgagctcctttaaaaatacagggccttgtggtgggtgctgaggacagaacaaaaaccaagtaatacatgaacataacccttgatttcatgatctagtagacctataaaagttgtcgatatctgatgaaaagaaaatggtaaagatattccaaacagtgtatgcaaatccagagataggatggaggggctctacctgaaggatgatgataagaaaaccgtgttgagtgaagggtgatttgtggaattcagataaaatatcagtcttgaatgctgagtgaatactcaatgattgactagatcccatggacagtaatttcttcaattatgacgatgctagtgtttatgactataactatcattctccatgccaggcactttgccatttggtaaatgtatagtgtgctattctaacaagcatgcacagagcttttactttaatgtatccatgagtttattggggttcagaatttaggtaagctttgcaaggtcgtagcatggagtaaaatatctgaaattcagacccatatctaactaagttcaaagactgtacagatatttctcctcctttgtgcagagaaggataggaatggttccatattatcatggacttagtcagatgttttaaaattataatgtcctgtgttaatgaagaagggatgatattcagtgcatattcttaaccgttactttgcttaatgctctcgacttttctgtgagatggatagtgtagataaaatccccaaggggactcagcaagtgcaagtaaaacaatgaaactttaaagccctttgtcaaaacctctctttttctcagaggatggaagggccgtaaaggttggtgaggaaggatggaccatttcctatgtagtcttctgacaatattcaaacaaaaggagagtcagcaaatcccccttgatgtgggaagttttaatacaatttgcagagtgtctctctggagtagacatcctcctctgcaatcgtgtcttctatatagcctcagggctttgggtaggtaatcctctccaaggagagtcctggagagggctgtctaccccccttgcaccatcctctaacattattctatagctcagctccttgtttctgtttcctgccttgtttttgtctgagtctgcaattatgatgtaagcaccatgaaggaaggtatgttgccagtgtttgcatcagcatatcccccgtgtgtagcagcgcaagggatatagtgagccctcaatgtctatttgtagaaaaaagaatgaacgtatcaacgaaatctgatacatattcattgtgtctgttatctccatctctcttgtcctgccttgttatcttgccattttcacaaaaggccccaaggcccatcatttcttgtgtaacttccagagtgttaatttttaaattaaaattaaggctttctacatgagtgtctattatttgagaaaccatgcaagatcgtgtgtgtgtgtgtgtgtgtgtgtgtgtgtgtgtgtgtgtgtgtgttgcactctatattatattgaattctggattttttcttataaataaaattttaaaaatagttctttaaaaataggaataagatgttttaggaggcacagagagcaaaggagaataaaaattgcaggtttggggttgtgcatactaattgccattgagtaaagagagcacactgaggccatttagaagagaattaacgtgttttgtttttgtttttgtttttgtttttgtttttgtttttgttttgagacggagtctcgctctgtcacccaggctgaagtgcagtggtatgatctcggctcactgcaacctccacctcccgggttcaagtgattcttgtgcctcggcctcccaagcagctgggattagaggcgcccacaaccacgccaggctatttgttttttttttttgtatttttagtagagacggggtttcaccatgttggccaggctggtctcgaactcctagcctcaagtcatccacccgactcagcctcccaaagtgttgggattataggtgtgatccactgcacctgaccttatttttattcatttaaaaatattaaatgttactgcatagggagtaatgggcttaacaatgaggtgaccaaaactcctatgtaccatgcagagcaatgtatcaaatgtttttaactataaacttctcaaaaacataaacctaattgttctgcagctgcaggttatatctgccttgtttgagcaaaatttggtggtgaaaatgccttgcttccatttttccttcaataactgatatggtttggctgtgtccccacccaaatctcatcttgaattctactcccataattcctacttgttgtgggagggatccagtgggaggtcatttgaatcatgggggcggtttcccccatactgttctcatggtactgaataagtctcacgagatctgttggttttatcaggggtttctgctcttgcgtctccacattttctcttctgcttccatgtaagaagtgcctttcacctcccaccatgattctgaggcctccccagtcatgtggaactataagttcaattaaactactttttcttcccagtctcaagtatgtctttatcacagcatgaaaacggactaatacaataacctatataattttgaaaagtacttgtctaatagactttcacaatagaaactatatccttatcaactttgaaaagtcattgcttaatgcctttggataactgaattttctaagattattttaattttgaaagttaaattttatcccagtgttgacgatttttgtatgctacttttaaaatattttgtcagtgatttatatctatggtgcaatcttgtaaaaaattaacaatgcaaatgtggctagaccatttaaaaatcaatatgttataattcagcccatttaatcactttagttaaacatcttaggaacaactcagttccatttgagagaagacacagttttctagatgtgtgttgtggcatcatattgctttacaatatcttacataaggtgaattcaaatcatatcattgaatctgttttaaattctgtcatagcttaagattagtgactaaatattggcaggtttatggaagtaggatgtaaacaagacaaaaacaagggtggaacaagtaattttagtatattattcacttgcacagagaaaagtcattcacaccttcttcagctttgtgaagaaaatagactaaaatcctgttgatatagcaactatgttttccgtttcttgtataaaaataaagaaaacttcctattaggaattagccagacattttaattttctctcttctttctctattttcccttacagtctctttgaaggcaggcaaaatttctataaagttttaagaatgttttaagatttttttattgtgaaatattcatagactcacaaggagttgcaaaaacagtacagagatttcctgtgtatacataacccaactttccccagttacatattaaccaaatacagtatattaccaaacccaataaactgacattggcacagtgcaatcaactagactgtagaccttacttggatttcacctgtttttgcacatgctcttttactgtgagtcattatctgttattctatgacattaaccatgtctatagatttatatagttactaccactatcaagataaagaagtgtttcatcaccacaaagtaacttaaaggattatttttataaagtaatgacaaatgtgtcaaaagccattcctgtgttatatagcaagtatgttttgagttattaaaactcactgatcatgtctttcagtgtcataactttgggtttccctccctaactataataatcctgatgaattacagttgatgaatatgagaatatccaactcttcctgactctataaatatattgactgagattgtaatatttatggtgtcttaaggggcgcttgttttattatgatgatgtgaacatgttgagaatagtaagaacagcccagtttagcaaacaggatatgagtcttctatatccagctcaatcgttgccccaacaggggacatctgcctttgctacttaattttccattctggaaaatgtgaagtgtatgagaatgaataatcgtctccgattttccagcacataataatctgaggagagcaggtacagcaatttaggagctgttttcttttggtttccaaaaaaagttccgtccagtggtctaagttagtcgtttactaagtgatagagcaattggctatgctttttgaacggactgataattatgtggatgcagcaaataggatatagacaatgcatctactccattacagtaaaaaagactctgatagcagttaatccacataccaggcacttagcttaggcacagttggaggaaatggaatggtaatagactgtagtatggcatgacaggagctgtagcttgagattcagaattccaactctgcctctcaatatttgagtcctcatggccaagatatgtaaagtgctctgtgcaggtcttggcaaccatccaccacacacttagtatgcaatatctatctttattagtcaaggatctggaaagctagttgatgagacaaatgatagaaacaagagttcattagatgaaataaagtaataaatgatgcaagaatttaaaaaagatttagagaaggaaagggaacagaactcacatgcaagtagagcaactgtgtatcagataatgtgctagctgagttagaaaccatgtctcatattaccctgaaaataattctgcaaagctgtaggtgttatttttttcatttgacaggtgaattcatgaaggcttgaatatagggttaagtgagttgtttcaatgtagttattgattcaaatcaagatctgaatgactctaaatatggtgctatagagatttgaagtaggataaataggatttgaaaaaaagaaaaaatatatagggaaaggaattggtacactgtagcagtgtcataaatgaagcttcagttgtgtgattccagatgatgtatgtgaggcctaatcaaacagctttgtggaatcaaaatttctgctcttgtctccaactggggacgagttggctcgggattaaggtgggcgaccttgggaagactagagtctaagcaggactttagtccctcataagaattatatgaggatgtatatttgcatacaaattcctgggcccaccgagatctgccaaattggaatgtgtggtgatatcacccagggaaacatagagagctgttataattagtcatgaaatatttagtactgaaattatagattatgttaaataatcacttataggggacatagcagggttggcaggttaaccatacagcaaacagggttgtaagtcagggcctagagaattttcaagaggcaggaattctgcagaatgaaggcctggtctcatgcagcaccatggacagctccgaggcactcttgtttctccaaaaacctgaaatcaaaaactttgcttttcatcatgcaacatacccatgtaacaatcctgcataggtactccctagtccaaaattaaagttgaaaaaaaaaactatactttcatttgaatacagttctcttcggctttaccagctctactctggaaggaatatcttttactcaatgaaaggccatcccctgttaatgcctggccaggttctccttatcagtcattcactatctttgtgtgtgagtgactaaacatataatgctatgtttagtggatggagtaagattacctttgcagaggttgtactggcttacccctttggttcttgtagttttcttctattagagttttttccatccctaggtttctatactgttcaaatgggtttaagattcttgaaggtattcctctgaccttgtaatttatgcttgtctcctagcacaacttttttttgtaaaggaggcaccaactatgtggtttgctggcgatggcatacacaaatcaggtgggaggaattaatgagagcagcaattccaatatctggttcttcaagattaacttgtatagtttaattcagcattctaaataagcctcatagatttaaaaatctagaataaacccacatttttaaaaaaagttttatgttatctgtgctgataatgcacgctgtacataataaaatattattttcttttttttaaatttattattatactttaagttttagggcacatgtgcacaatgtgcaggttagttacatatgtatacatgtgccatgctggtgcgctgcacccactaactcgtcatctagcttaaggtaaatctcccaatgctatccctcccccttccccccaccccacagcagtccccagagtgtgatattccccttcctgtgtccatgtgttctcattgttcaattcccaatattattttctaagtggcagtggaagaaacatggaaagttctacttcatccatcggtggattagaatttgtataccatgagatgattaattttcaaaaccagtttgaatctcacaaaataatgaccctgttttttgaaggacaaggcagaacaaggaactaggctgtgccacgttcaagtcacaatctctaacatttgttttgttttgttttgttttgttttgttttgttttgttttgtttaatctctgttgcttgttcactttctcttgtaatctgcattgatttgctacctggctatttgtagattgacttcggctgccaggaatggaatgtttttcataaaggaacatatgccttaatgaaagtaccataagaagggagtagagtgtgaccaattgcctaggtaataagtagtgacaacaatgatattattctagtataaatggaatcagtttttctttgcccagggggcatgataaagaaggcctggctggtatatactaggtgggacacaccaacagtgcctagaatgtcaatggatcaaacctgagggaaccagaagttgaaaagacatatcccaaaagaaagcatttgatgtttaagggttggcttacttagaacacaatgaaaaatattactaaaattaaaactatgattttagctatttttaaatatgacaaattaaatagcagaacattttaataaaacattacttaaggtccacaattttctgtaagtctaatacatgggtcattaaaataaaaaattccccatgatttatggaatcagatttttttaatacaacgaattctaaatggttttataatgccaattccaattaatatcctaattataacatgtcatccagaagggttaatgactaaattttattaatatttgttttctatttattttgatttgtgcagtttatgtgtatagtaacgatagctgcaaattagataccattagcattaaataaggtatatattttaatagaaaattaaagttaagtatttgagctagcctaaaatattcaacaacttaaatttgttttttgtggatcacatttttttgagacaaagtcttgctctgctgcccaggcttgagtgcagtggtgcattcatggctcactgcctcaaccatccaggctcaggtgatcctcccacctcagcctcccgggtagctgaggctactggcgcacgccaccatgcccagctaattttttgtatttttttttagagatggtgtttcaccatctggtctcaaactcctgagctcaagcaatctgcccaccttggcctcccaaaatgccgagattacaggcgtgatccagtgcactcacccctgtgaaccaccattaaatagctaataaaagatgcatgtcaataaaaataaacaacttactagaatgattatgtgaaaatcatttattcttccaaagcatgaattttcaaacacaccttttgttactgttttaagaagggaatcatttccatatatttgcatgtaaatcacttttagtctcagagaactttccataaaagtttttttattactgctgtaaccgatagagctagtggactattaatttaaaaagctgtacataaaaacacatctatagctcaaataatctaggataccttttagtttggggaaatgtagatgaaaatgaagtaattacagaatccttgttaattttcagatttagacagtctaggcaatatctttcaggaatgaagagatatgtgttttttggcatcttggtagagtatattcccattgtaattcttttgtgaagtctagaccagatgtggccataaaaatagacccctactacaataatatatttcatagataatccaataaagtcaaatcttattgcagtaggcttagaactctgtttgcacccatggaatttatatcagtttttggcaaatcctttcatctctgaggatactttttcatctcacatataccctattttctgaacattttgccttcaaagtatacctcatttatcaagaatttctctttattcatctgacttatacaagtggcaataacaacgtctggttcccatgaagtaaccagtgaccctttgaaataatatagcgctggaagaaagaaaaggaaagggagactgatcattcagcaactctttaaaaccatgtcaccgttaaacacatagtttattttatcttttttttagaattgtgaaaacctatattagcatcttcacggatgtctcctttgtttacatccccgcttctgtgccttgcctgcagtagaaaaaaaaaggacatgtgtatccctattccccattgtcttctcattctacatgagaatgagaattcttttaatttcttctctatctacatgaacccacttccattatctgtttgttcagttctttaaatgccctgaagctagctctgtgactgggcagttgaaagttctggacttagcatcaggttaatttgaaaaatacttattgagccaccaccatatgtcagccactactgtagatgttttgaatgtgtcagtgaacaaagcagaaaagatgtatgccctctggattcttgggggtctcaaatagtgaaagacagatacgataagtatattgtatagtatgttcaaaagtgataagtgctgtgaaaaaaaagaagaagggtaaaataagagatggctcatgctggagtacattccaattttaaatagggtatcatggtattcttcattgagaaggtgacatttgagcaaagatctcaaagaatgaggcatggggttgaatcatgtagatatcagcagtaaactcattttgggttcagtaaacagtcaatgcagaattcctaagccatcggtttatctgctgtttggggctggttatctgcagtgtggctagagtgaagtaagtgagagaggtttaggagagaatgttagtgaggtgagggtggacctttgaagccattgtaaggacgtttttctctttctaagtgtgagaagatgatgctgactgagaccagggtgataagaaatagtcatattctgaacgtgtttggaagtggggccaacaaggatttctggatgaattggataaggggcatgggagaaaaatggagtcatgaatggctccaacgtttttgctctgattaactggaagggataaagttgccctaaactgaaataataaagactatagatagaatggggcgattagggaggcattaaatttggatatctgttagacatatcaccagatatattgaataggcaattgaataaatacctttagagttcagcaaaaaaggtccaggttggacgtttaaatttcggaggtgtttgtataagataacatttaaagctgtgatatcagattgtatcactaaggaagaatatagatagaaatgacaacgtgactaaggactctaacattaagaggtggattgacaaaggagaaaacagcacaggataatgaaaaggaatgatcagccaggcatggtggctcacacctgtaatcctagtactttgggaggccgaggcgggcagatcacgaggtcaggagttggagaccagcctggccaacatggtgaaaccccatctctactaaaaatacaaaattagctgggtgtggtggcacacacctgtagtcccagctgctctggaggctgaggcagaagaattgcttgtacctaggagacagaggttgcagtgagccaaaagattgtgccactgcgctccaacctgggcgatggagcgagacttcatctaaaaaaaaaaaaaaaaaaaaaaaaaaaaaaaagaaaagaaaaggagtgatcaatgagatgggaagaaaaacaaaagtgtgtggtgtcctcaaaaactgacgttctattttcaaaacctacattttgggtctccttttactatatcctgactttctagctatataaccaaaaggagaaagcagtaatttttttagatataacatgttaataactctaagggtattcaatgaatctgaataattcagtggtataatgtgaaaaaatatagtattcataggaaaaggaacagaagttagctcaggaaatgacttgaatgaacaccgaagccaaatctccagcgcaggtccacgtattatttgtctcagtggttgaattagcagcaagattccttagtaggatgaaaaaagatgttgtgagcatctgtatctacatgactgaattaaattcctccaacaatgaaatgtagttaacgtagtatctcgaaaagaaccctaagtggaattcagggaacctaaattccaaccatggttttgctgctgactgattgcattcacttcaaatctatcattaacctccttgtgcctcattatcctcatttcaccaaataagaaaaatgaaatattcctccttccctacctcactaggatgttgtggatttaaatgtgtgagaagtgcttgagatgcataaaatttgatggagtgttttattcatgaattcaaggcatctgaagtaatttgaccatgatggacagttgcttccttgcacattttttagagtgacatttccgttactgacccacccatttatgcaacatgttgcctaatctaaatttaggtcaaaacaaattgaccttataggtaagcattatatctattaatattgtatttttgtattattttataatattcatcattcacctattttctcatgcaatatatgttactgaacacatatagattaaaaagccttcatccctaaataacaatgatgggaccttccatttttatatccctctggcatttaaaatgtgcttttatagccatcatctccattgatctctcagtcccttgaggttgatatgacagatatgctttttccattttaaaattacggaactgacagtctcagatgactttaccctccaactactgtgtgaagaagcagggtctggcactgaggtcttctgacatccagtgtagagcactatacttcacaatatggccattggcttactttattacaagcactaaatattttccactgaatacgtaatacctagaggagaatgtcgtgtaaaacagcagcagtagaacagaggattaaatgacccattttcttgaagttatcttagttttaaagggttttttcttcatcactaatgaccatccctgactaagaaattattctcataatacatgataatatctgcgttttccaatgcgacaagaatgttaggatgtctatacatgatcttgacaatccctagctccatcacaatgtgtccaaattcattttatttggctagacaggcatgtagtcttactttcaatggttggctctgctggatgctatgtgatctagaacctgtcacttaccccttctaaacttcaggaattttttatccttaagataacaagaaaactcgtacctgtttcaaagagctgtttgttcaatcacctatccattgattatcttctatatgccaaatgtttttctaggtgctgaattacaggaatgaatcagaagcaaaaagttcttactctcaaggatcttatatgctaatgaaatagatgttaaaaaataacaatttttgtttcattttattttattttattttgttgagacagagtctcactctgtcacccaggctggagtgcagtggcacagtctctgctcactgcaacctctgcctcccgggttcaaatgattctcctgcctcagcctaccgagtagctgggattacaggcatgcgccaccatgcctggctaatttttgtatttttagtagagatggggtttcaccatattggccaggctgttctcgagctcctgacctcaggtgatctgccctccacggcctcccaaagtgctgggattacgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgccaggagatgaagggagagatctggcatgcatcagatgatgtgcagtcttccgggacgttgtaaagagttgggctttttttgtttataaattaaatgttaagccattggggtttttaaccagaggagttatgtgatatgatctatagttaaattatgtttgttcttggatggagtgtgcattatgggaatttatacagaaacaagatttcacatatatatatatataaaactcagtgtcaatagaaaataataaaaacaaattttatccattgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggaccaaaaaaaaaaaaaaaaagtctttgaaaaatgagaaaggaaggatagaagaaaagattctcctttggtcaatctggccaacctttggaaataaaaagtattgtgttgcagctaataactatttgtcactgcaggcacttgctgatgtctgccctttaaaatgacccaaactcgttggcctcgaaatcagaagccaaggaaaaaatcttggacataatgttttctgtagaattaccaattttctctctctctctctctctctctctctccctccctctctctctctctctccatatctatatatatatagatgtatatatattttttctgtaggaactaccaattcctatctatagggactgattgagaagtcccttatagcagtttttctttggcttttaggatgcaatgattattggtgagaataactctttcatttcacatttgtcattggcttatttgaatgtaatcctgattcaatcgttatgatctcctttaagtaggaagagaagctggtattacattgtaggattttaattttgtactcatgaaacttttgaaaaacattactcatactcttctgactgtcaaattggcctctaagaggtccacatctcaagaggtatcaagcattggtaactattttttggtgttgttttctcatcataaaatgtacttttattaggtgactttggaaattttattgaatcaatgcatgacactgcctcattctagtaatctgatgaagcaaagctgaaaaacaaaatttgaggattgtcagtatatatacttttatttgcagtcaagagttatgctgcaaaaatggtttattgaagtaacaaaattttagctgatatattaatctgaaagatacagtatacatttttagtatggaaaagatgaggaaaaggaggttctctttcctctaggtatctagagcaaactgtaactgtccttggtatttaatttttggctaaggtactgagattagaggtggggccttagatatgattaattgtcagactgataagctagatatttcattgagtttctgttgtgctctttctttcagatcctctgttcgatgctttgttataaagatttgggcatttcaaaatcttctccatatctggtgtctttccaaacagcaggtcatagactttacacaaagaggaacgacacaggttataagtagaagtgttttaaaccctgagttcctatttcagttttgctttcttaaacatattttccttatgtgataaatgcgagtgttgaatggtgataaataccacccataggctttaaagcctaaatgttgaatttgacactgagagtttaaaggcatcatgaaaatttctccagaactaatgttcaagcaatttaggttttacaggcaactcaatagttttgaatgatgtagttattttgaaaaagtcaccataaaacgctatgtttagggaattggtactttgcatttatcagaagattgtaaatgtcaatcgattggcttgctatttggaatataattttttaaattatagttcaaatcattaggatttaattcatgattttgtactacaaactaaatctatgaaaaatatcagatatttattttaaattagaggcatgtaaaggaaaatataaattttgaaatgccattttactggatttttctcttcagcccaccctaggcatttgttacataaaatatttctgaggaagtcttccactgattttgtaaacaaacatgttttattgaacagttctttgttgactagattaacattgaccattgtatgcaatgcattctcaaaatcttagaagctggttttctttttaatcatataattttacttgttttacagtgaaattaatgcatgtaaaaagtatacctatatagaaagttaaaagaatattgctaactagttactatacttccaaattgcctattttctgtgtcttgcattggacagtagtgattacctctaaaagaaaatggatggtctttgtttcattgaagggatggataatggacataactggcattcttgagcaatgcaattgcaaatacatgtctttgcatttatggtccaatcatcttcttactatgatagcatataattgaaggttcaaataaatgcctcgtcccttcctgtggcatattaaagagaaagaaaaattagaaatactttcaaagctacctcacatactaatggtagagttgtttgagtatttaggtgatttaacaaagctgatgtattttattatgcttgatcattgaggaaaatttatttatcggaatgcttttgagagcatatatattgtcagagataaacacagctggatattaaagaggtaaaaacagattttattcaatacctcgtgaaattaggggagagctgagatccattctaatttgtgcagaggcgacttggttgttttaaggcaagaaggagggagaaggagtgggggttcattcgagttagagaagtaaaaaagtacaaagggctggacagtgtaaatgtgattaggccagctgtgttagctggaagttattgaagttaggattctatcttcccacagagaacaggagacagaggacttatccttcttgatgatgtcatttgaaaagaatggctttcaggtccttgagtgagagacacttctgatttccaagagctacatgttcacaattgtaagcccttttgagtaaatgttctaagaaacggaggtaagagtcctatcaacagatgtgtgttggctagaacaaacattaaattttcctggcagcactgagctttctcaagcaggcacttaagggaaggctagggtcatcctagggacatggccttctggggctagaaaccatactagagtttagtcaagtcttagtgcaagggtttggacagagttgttaagtgctgagagttctgtatttctcactgtcacaaaggaagatcagaagctcctgatacttttttcatcagtacaattgaatatataaatcctatacacaaaaataaactaagcttatacaagcatattggtcaaggaatgttgctggccttattaattagatagcccagttaaaagaagaattttttaatataattaatgttaaagtaggatgatagtatataaaacgtgtctactgtcctgaatacaaactaaactgtttggtttagcatttacctcaagatctcttaatatcccccaaagggtccctaaaaccacaacttatctttgtgctcatgaagtagagaagagacagttaatagacatttctagctgatagactgttgtagagcagagaacgctctgtgtttttgaaaattaaacatatgaatttgcccctcttcccctattaaggaagaagagtttcttaattgtgcgaacacatcaagtgaactattcaattagatttttgtgacccagggtataaacatctggttaaggttacatatttcaaaggaacaaaacactagaaactcttggttttaaatctcatggctggaggataatttgcagcagagatttatctggcaagcatacagaattgctgagactgttctaaagatgtaagtgtgggtgtttgtgtcgtgaaaatagctgtttacatctattaagtggataccgatggttgaaagtgccgtctatgtcaagtttttaccaaatcaacttttgcctcactgtgtcagaccattttacctaatcaacttggactgctaatgtcctttcccctggcaccactatctgtctcttttgcaaagcacagaaacggcatgcatgattgtagtttataaaacacatgtaccaatgtggtctacagcttctgttgagttcgagagggtcagtttctgtaatctcttctggcacagagtcaagaacagcttcactttcctcctgctacctctctacccgtaagtgtgaacccatcactttgctaacactcaggaaggggattacacaaaatagagcaggagccctctgacctgaatatgcatctgagccctagccatagagcttctgattcagtagatctgggatggggcctaaatatttgcatttttaagtgtataagtgatgctgatgctgctggttccaggaccacattttaagaaatatcgataaaggtggagaattaaactgcagctcagaagacctgagttcttgccccagcttgacttttacaatctagcaaatggataaaactcgcaggacttcagttctcttcatctacacagtgagtggttagattggctttgtaatttaaaattaaacagggtttgattctgattcactacacaaggttccaaagaaggaatgatatctcctttcatttcttcactttgtcttctgtccctaggtaatcttatctatgttcctgatttaacctaactaatgtttctgcaaagcttctaatatttacatctccagccctgaaactctcatttgaatgctagtcttatatacatacccccctgcctaattgacatctccacttaaatgtatcagaggcaactcagactcaacaaggaccaaactgaatgttcgaccttgtccttcaaacccgatacacatccaggttcctccatcccagtgaatgacactatccagttaagcaagccaaaagtctggattttttttcctcactcttcctcactgtccgtcaactaccattattaaatctgtcacctggtcctactgatttaaccttctcaatatctctacagtttttctttatgcccattagtatcctagtgcaagctaccatcgtctctcattggaattaacacagtaacccccctacccaccagactgttctgcctacagatagtgtgatatttaataaatataaatctagccttggctagatttctccttcaaaaggttcacattaattttagccttaaaatggtgtgcaaagctttgcatagtctgtcctttgctatgttggcagtattttttactatccctctcatctgctcattctctgtactccaactacactaactttgtttttttttttttttagatttctctaactacagtgctgtaatctctttttcctttgcacgtactattccgtttgtcagggaatctgctcactgtctccacccactccacacactcacgttttcctgcccgtcttaccggtcttgatcggttgtcacttgctcaggaaggtttccctggtcaccccctccacaaattgaattaagtcctcttgctgcatgctgtcctagtgctctttattttcctctcctcatccttaattcagtttgtaattacatgttatttgtgtgaggatttgattattatctgtgtcacccactagatattgggcattctttacttactcaccactgaattcatagaaccacagtaattgtacacaacaaatattcaagagaaatttattgaattgatgaatgaaaagttgtaccttaacatgttcctgacatgtatccaaaaaagagctcccctttggggtctattaggactttggacctaggtaaacgtaaccctagtttcgctcaggtttaaacagtagaaagtaattgggtctcttttgcatgtggctttcctaagggctaaccctgtcttcggaatgagtcaatacagcagagctgttgaaagcagactctagcttcggacaacgttggtccgaatcatggttccgtcatttcttagctgtgtgatttagaataaattaatgttttaaagctttgatttcctcttccttaatctggagatgctaataaagccaacttcgtagaggtattgcgatgagtaaataagcataatttgctgtaaacaccttgcagattgcctgttgtatgctaactaatcaataaattgaagctcttaacatcattatattagatatttccagcattgagtatactatcaggcatgtggtagaagctcaatataaagttttgttaaattgaatagattccatatatggtatttctacagcattatgctccttatttaagtgtctctaagtattttttaagtatcacctcacaaaagacagatgtttaattcattacacatgtgaattgttttagatagaaaataaaataaaaaattcaaacattgaaatcaatagtgtaccttaccttaggattacaccataaaatttctaccaatcgagaataaagtgtacagtctatttcctttctaatacttttaacgcaacaaatgtttattgaacacttactacttctaatctatgacagacataaagatgaataaagcatgccacaatgtttaaaggagctcactatatcataagaaagcggattcacacagacaactctataagataaagtggtaaatttaggctggcctgtgaaacaaaggattataggtatagttaagaggtggaatttattttacttcgaggatttcagttacctttatattctttgtctaacctttcatgtttctctttcttcagaaacagagcacctttttcctgacacattcatttccccctatggagtagagcagttgttttcaaagtgtgggtcccagatcagcatcacggggatggttagaaatgcccattcttgagcctcacaacagacctactgaaacagaaattcttggagagtggagcccgcagatctgtgatcaagccctgtaggcaattctaacgcacactcaagttaaagaaccacgggaagaaaggtccatcctgtaacaagacagatttttttcattagcatcaattttgatcatttatatatatatatatatatatatatatatatatatatatatgcatgctcacaaaaccattcaccttactaggttttagtattccccttcctgtattcatgtggtatgtatgtatacaagatgaacacacatttacctgagacaaggtaagactacacatgtctcatttggggaccagaggctgtaatcttactcaaggtcaaagcgtcttcactgctttctttcactgcttttcaaaagtaaaatttccatgtaggtgtcatttgttttctttttgtgttttagaaaaccgattaaggggtgaagtctggctaaacttagtgtcaggacatttacttagataaaattattttaatttatcttgtaatgttcaatgtgagaagaaaagtccttatgagtagtgtattccttaaataacaacaatttaaaaactaccactgaagtctgtcagagtagttttgcctcatttgtctagataagagaaaaaaggttcacattagggattgcaatttgtctgccaaagtgcagtttatttattcagaaacatttagagaggaatgtgtcagttctgttgcaggcactgtgctgtgacggggagctcaagatgatctcaaaaaatttcacagatggggtgggcagggggcacagagagatgtatttagtggttcagatactatttagactgtggccagcatttctctaaatgcaatccagataacaccttacagaatcatctgggcagcttgataaaagctgtagactcctacccttcatcccaaacctattgaatcagtgtctgtgtgtgaagacctagattgtgactggtaattataccaaagtcttagaagcaactctaggccagtaatactcacatcagaatcagctggagggtttgctataccacagattgctaggttagccttcagagttgctggtccagtaactttggtgcaggtccagattttgcatttccagcaagttaccaggtgatactgatgctgctggccttgatcgtgctttgaaaaccactgctttagctacgctataggaaaaaccatataaggcttttatactggccaatgacttcacaggcctgaattttagaaagcccccttctgcagcttggcctatagattcgaaggaaacagaactaacacaagaaagctagttaggagctagttaaaaatcatcctgacttgccaaggaaaggtgctgaagacctgggtcacagagcaaatgcaaaacactaggactttgtccctagttcaccattaaatcaacttattttctcttaccccctcatattcacgtttactccttactttgtagtggttggacaaaaatcaaataaatctgagaattctaaaatgcacacccttgtttattttctaactcaaatatgccactgttgtctgtgctctgtcaagatttcaacacatctttttctcctgtttgcttttccttttggcatatagtgagtgtgtgtatacacacacacacacacacattttttttgactccttccaatgcccttctgctctccgcagatacacttctgcattctgaataaaaccgaatacatatatatatatatatatatatatatatatatatatatatatatgcacacatattttgaaaaccttatttgaaaagaaagctttcggaggaaacgttatttagccacttaatcgagtcttttactgagggactttttgtcgtcccctaacttcctgtcagcagtccacaggcagcaggaataatgtgggagaagatcaacaggcttatttcaggaggtcaggggccagtgccaccacctgcaggtggagacatcagaagcaggaagcagcccaccagctgcagggagaactccccacagagcctaaccaagatgaagggacttgtaaatttcaaccctcccttttggcttttgtgctaaaaatgtgaatattgaggtctgccctgattaagaactagatacattcctctttgtgactgccacacttccttagcgtattcattttttgtctttcgatctcaagttattattttcaaatgcattgcacgtatctaccatggataccattgcaattggaaggagcaaacgttttgtatgtttacttgacaaagagaagtgactgcccaagccacacagagttctgcacaaatcagtaacttctaacgaacgtttgcacttccgggcttgttctctacctatttcagtcgatgcatttgtattatttacttcaaactccaatactaataatgcctcaatcaggttgcaattgggatttgagcagccagaatttcagaaatttggtttggtccatatctgtgacaggtcagtaaatcagagaagcaagggtttggttgctattataatacattgcttacctatcaatttagttatcagccaaggtggttgttatcatccaaagtggctcattaaccaccttggagactcagtatacaattgcaagtaaccctggaagttgtaaataatcccaactgaatttgtatgagtttggtaaggttaagtggaaaccagctgcttagggccttgattataaatgaagttaggagtggaagaagtaacaaaaccccaggcaaattcattaaacattttttcccttcaactttatgctcacgaatgtgttgagactcttctgaatccataaaacacctttcagcatcatctgggcagcttgataaaggctgtagactgcctgcccttcatcccaaacctactgaatcagtgtctgtgtgtgaagacctagattctgactggtagttataccaaagtcttagaagcaactctaggccagtagtactcacgtcagaatcagctggagggtttgctataccacagattgctaggctagccttcaaagttgctggtccagtaactttggtgcaggtccagaatttgcatttctagcaagttaccaggtgatgctgatgctgctggccttgatcatgctgtgaaaaccactgctttagctaggctataagaaaccatataacatggacaaggcaaatgaaaaggttggaattcttctgaatcccaacacatttgtgagcataaagtcgaagggaaaatgattcttctgaatccagacacatttgtttaaggataaactgttttttccttctgaaaatttaatgtctgattctcgttcattcattcatcaaaagttatcaactatcaactataggtaggaactgtgcaatatgctggtgataaagagatgaaagacacagcccctcccttcaaccagctcctagttgaggtggcaagtcagctgtataatcaagtaattgcaagactgtgcactgaaaagggtgaccacagggtgtgatggccacccagggctgtggaatcagtcccaaaatgaagaatgaaagcagggaagggtaattcagaaagaagaaacagttcgcataaagacccatagataaacatcaatcagatgtggttaagacaaaagtaagtttctggaggctgaggaccttctcagctatatgtttgcagtgcttggtatagggctttatgcatctacatggaagacagaaagggccacatcacagtggacaaggcaaatgagaaggaggcagtatcagaagatgagggtacaccggagatcctagttatatatgggcattgtgttcatctcaggagttactgagtaatgggaccttgactcaaatgaatctcaagtctgtttttgcctaatcttggttttaggactaggattagcatacaaccgcactaggagcctagttatacgaaaggctgcattgcggacctgatacagttcaatatacatactgtcaccttgcaaatagggttacgttagttctcaagactgccaatcctctgtgctctaatccttttggcttttttttttttttttttaactgtctcactctgtcatccaggtgaagtgccctgggatgatctaagctcactgaaacctccgcgtcccaggttcaggtgattctcatgccacagcctcccaagtagctgggattacaggtgctctggcgccaccaggccctgctaagttttgcatttttagtagagacagggtttcaccatgttgcccagactgatctcaaacgcctgacctcaagtgatctgcccgctttcctttggcttttaacactatagagcaagggtccccagccctggggccacagaccagtacaggtcagtgacctgttaggaaccggggccccacatcaggaggtgagctgcagggccgccagcattaccacttgagctccaccttctatcagctcagcagcggtattagattctcataggatcacgaaccctattgtgaactgtccacacgagggatctaggttgtgtgctccttatgagaatctaatgcctgaagatctgaggtgcaacagttttatccccaaaccatcgcctcccacgcacctctccccacaaccccacccgcccctgatccatggaaaaattgtcttcctctaaaccagtctctggtgccgaaaaggttggggattgctgctatagggcgatggttttcacatttgatcctgcatcaaaatttccaggtgactcattaaaatactgattgctgtgccccactcgtaggagttctgataaggtagctgtggggtgagacctgagaatttacttttctaataagttcccaggtcatgctgatattgctttgataaccaaagcaatatcagctttggttatcaatatataaccaaagccacatagagggggagaagttccttgggtttagcccagtgtttactgcgaccaccaaaattgctggagcttaaccatggctcagagagttatgttctgttcactctgtaggctgctattccctgtcaccttttgaactatgatggaggggaagagctgccagctcaggagatttcacttttttctctgcataattgaaaatccagaaacacagggttttgggaaagctatagaacagatcatcagtgatcagtgtttaataaagtaaagcaataaactttactgtgtaaaataggatactttattatataaattttgtccccttcccccacctcacaggccaataaaataatatacttcttgtccctgggtgtaatgttattggaaacctttgaatgtaggagaggcatgggcttgtaagttgcagaaaactgctagcctaggattgagaatttcatggataatccaaaaatagatgattttacagttataagccttacgtgaacttgaggtaagaaaacacaatgcctttatagtcttctcagttgctccacatgccctctgagattctgttctgcccagcctctctggttgtcacatctctgggcattaacagaaagttcacatactctttgtctctgatgataatccttctaggtccatatagaagatccctatccaaaccatcccccaaacaaacctattggttaaatattttctccaccgaaggcactttcttagattctaagtgccctgtaggcaggcttcctctctgatttgggagagtacaaattgcgacaaggttaaatcatagcctgggaatttgacctaaaattcactcttctcccatatgcattcatgaaccttctgctggtttttaaaagaagctacttaatgtcagctcgaagaggttggaaggggttaaaaacatgagcatggcagtaagaagatttatgaaggatctgagaagattatgacttgatcagatggtattttgtcagctagccacatttgtgaagacttgaaaactagggaggcttgtccttctaagagggggcactgctgggacctggattctgtggaaccgtattagtagaataaacaataacctttgcttgtatcaaatgaacttctattctcatgtgtcttttgacatatttttattaatcatatcactgggacctccttgctgaaagatatctccgttccccattctgatgactcccaactaggagtgagatcaaatgaagatggcatggaccatttctccatgtgacagctctctgtggttgccttttaacacttctaatgccctttctcttaagaattcccatttgtcgtctggcactggtgctgtgatcaataaaaatgtaatggagtgaggcttagaaacatgaggaaatttactcaagctatccatttattgatgtgtccatttgtgttgtcagggaagaaaaactttttcactcccctcttaggttcattacttggggggctgcaaattaaactgacgacagatagattggcaatagaaaagacaaagtttattcagagaagtatgtgggagctcacagaaaacatagctcaatgaagttagaatttggggcttatgtactattttaacaagggttttgaaaagaagagtgttagaatttcaagccacaaagttggtgggaaatatgaaagaaactaatgaaaggtaatgtttgttttagtaaagtctgtttatgtaattttcttttcccagcgacaacttctcatctctggtgacaggagtcactctttacccctggtgcaagaaactttccttaaaggaggatttaaaacagttgaattatttcagaaatctttgcttttaggcagatagggggagtacagaaaaagccccttcccgtatctgttgatcctcaaatggctttagctcaaaacaatttttacatcacgatggcataatgtagatctcttcaatgtgttcatttattccacagatatttgtgaagtacatgatatatgccaggtacttgggatacaagaatacataagtatgtccctagtctcgtagaacttacactctagtagtgagctagagaataaatgatattatttattatatgcatacacatatgatttcagatagtgatccatattggaaataaagctggttaagggaatagaaaatgatattgaaggtggacttgtttagattgggtggattggcatggcttctctagggggcagtatttgagcagatatgagagcagatattctccaatttgggcaaaaacattccaggcagaggaaacaagggcaagggcactgagttcaaaagagacttgacctagccaacaaatagcaaggattccagtgtaagagaaggtggggaaggaaggaggtgcaagtataggcaagggcaagatcacacgggatcttgcaggccgtgataaaagaatttaactctttcataattttgacaggacatcattgaagaatttagaaaaatagagtggagatacctgatctgctttcttcaaagagttcattcatcattgctgagtagaggttagactgaaatggaagcaatagtgaatacagggagatagcacaggaagccacgttactagtccacatcagaggtggttcagactagggtggagtggtggggtcagttagagagctggtatttaggatacattttaaagacaaagctgacaggatttgctgtgatgaattagatgtaaagtatgagaataattgagaattatttctaagttctttgctggggaaaagtggaggaggaaaaagttagggtacaaggtgtgatgaaatcaagagtctctcttattatcagagtctcattagatatccaagtggaaatgctggaaagaaagttgggtagatcagtctgaagctgaagacagatactgtgactggaataataacgtaagagttggccggacacagtggctcactcctataatcccagcactttgggaggccaggataggagaattacttgagcccaggagtccaagaccagcctgggtaacacagcgagacctcgcctctacacacacacacgcgcgcaaaaattaatcgggtgtggtggcacatgcctgtagtcccagatactcaggaggccgaggctgaaggatcacttgagcctgggaagtcaaggctgcagtgagccgtgatcacaccgctgcactccagcctgggcaacagagtgagaccctgtctcaaaataaataaataaataatgtggcagtcataggcccttagatggtttttaaagacatgggactggatgaagtcttctaggaggagagtttgggaaaagagcccgagaattgactgcacctttcaaaacaggaggaagaaaaaaaatactcaaaggagacaaaagcaacttctgtgatttatagagaaaaccaggcaagtgggatgaagaaagtccttcatgatagaatcaaaaacagtgtcaaatgttgaaaatacaattagacaaacacaaaagaatagaccattgggttttgcaatatggagctcatacttgaccttgataaaagacattttcactggaagcatgcatcaaaaaactatttgtggtaggttaaaatgtagtaggaggtgaggatatacagacagtggctttcactgtgcagatactgctgctcatgcactaattaaaagacatttgttgagtatctactatgttgtatccattgctaaatagtaacagctgggtttagtcaggtagaacagcatcaaaatcattatagtatcccaagataggtacagtaaaatctgtgaaggaatcagagtagtctcttctccaacagagcgtaagacccagcttcacggagaaggtggtagattagctcatctgggaggctgagtagaagcttgtcattatagagggagaacatcagaagtgtggacaacagcttgaataaccttgaaaggacaaaagaggacggtctgccctggaaatattaagaagtctcacatgattagacacaagatattaggggaaaggcataaggtgaattgagtcaatgaggtcaaagagaagctagctggaggaacaggcgatcataaaatgagtaaaagtatatattcaaagattctttttagaagggctacacaggatggataaggggagagagagagttgaggcacagagacaaattggaaaggtgcaatcataaccagagacatgaaaaacccatagaaatctgatgtagattatgtggtccccaaggttgaacaattaagtacgctttcagttgttatgcccatgatattaacatattttataactgcaataagtgctgaagctaaagataaatacaaacaatgtaattcttattctgtgagaaaatgttgtagctggaagttaaacatgtttcttagctaaagaaaaatattgtgtgatctggattacttaatgttataatttagcaacaaaatgttgacattgagccttgcataatcaaaaaagtagtctattcaataaccacattctcagaaaaaaaacaagaaaatattagaaacaatgataaattatcgtagtaatttaattcagtattctattgttttatttggatttaggaaaggcagaaatgttgaaatattaatatatatccctgtaataatataatttgtgtctgagaggtaggaatgagggcatgaggtcaaagtttgataatgaacttcaaagctataactatgatcaggaaattaaaattggacaataaattcctagaatcgtcaggagttgcttgtgaaatcgagaaaggaaaggatatacacaaaaataaagaacagccaatgctctcaaaggagtctaacttttataatagtcttctgtgttagagctgaactcttctggtttagaaggacactctgttgcctggaaatagggcatggaaaaagtcatcagagtcatgtcatctttcattcttcccatgaacgaaatcgaggccctgaaaagtcacctgtgtttgctgtattttattgcaactaagatgtgcatttttaaattgatacataataattgtacatatttgtgggatacatgtgatattttgatgcatgcataccatgtgtaattatcaaataaggatatttctgtatccgtcacctcaaacatttaccattgctttgtgttgggaacatttcacgtattttattatagctattttgaaatacaaaatagattgtcattaactatagtcaccctactggatgcaccttgtttttaatatttctgaaaacagatacgtctcataggtgatggtgtcacagctgtgcattagttattattgcctgtgcaggtgcaaacgtaactattcatattgttgtcaattaattaaatagttacatttatttatatgcgtttattatactaataaacacaatattgagatagttgagctctagttttgactctgctgttaactagctgcgttactttaatttacttaactaatttggctttcaaattcctgataagtaaaattacaacatgagtttctcctgctataatagcctgagaaatcggtgaaacacatgaattcagatgttgatgctatttaatagcgggattccagatatctacttgccattatgggagggagagaggaggtggactggaggctgtgatttccctaggaggttgttaaaattggccaggtgaggaaagctgagacagaccataaatatgaagcatgatacctagccctcagtgttgaaagaaaatcaaatctcatctttgtggtctaaatatcagtatgatacaatcctctgtgtagacatatcctctgccctattgttttctttctaaaagctaaagcccaggtgtgatcacatccctccgttatttacaaatttctgatgatgatgattcttctaatatctacattccttaccattaccatgatgtccaaaacctattataatctattcgtctccaagtgccatgttgtggtcaccctatgcaccctctaaacccaccatatgaccttcccgctgctacttgaatacagttggccctctacctcgttgtgtctttgcattgcctatttaattgcctttccattctctaaatcactctttcgctggaccagcaacatcagcaccatctgggaattcattagaaatatagatcctcaggcctcatctcagacctgcttgatcagaaacattggagagtggagatgagcagcctgtatttttatcagccctctaggtaatttgatgcacactaaagtttgagaaccactggtctagagcattcttctttaactctcttctaaaaattattagaatgaattcgagggacgggatctccttgaaagccaagaacatttctttgtcatctttctgacttcagggcgtagtacactttttggcccataattaaagctcgataaatgcattctatgccaataaatcagctaatcaaatatattattcatgcccttgaggtatctgaaatttgtttgcagaatgtaatatataactatagagtaacaagagaataatttattgccatagataataaaacaatatcctctgtataataaatcctagcctctgctcaatgggcaaaaacgggactggggtttcagattttaaaaagattattggtaattaaatcacctggagaagcacttgctgcagagatgggacttgaagcatcataataaactgttgtttattatgattcggtcagagctgatggaatcacagggattgtgtgaggtatggaaagtggttgacattgaattccaggctgcacagttgggacttgatatgataaccaaaaagaaagaatgtctggggtggtagcaagctctaaatttagacaatctaggcttatcctaaggagaatatagatacagataactgaagtttgattaaagggaacctggtgtatcacaaatagtaaaaagctgtagttagtctatgcagctatcagctagccacataatacttttgggcaaatacattataaaccaaaagaatgacatggcttatctctgtaacaaagtggctcattgttctttattctactgttatccttaagaaaaaaattttagtaaatttgttatgctatactcaacttcaagaagggatagcgcttataaaaaaattgtttaaagaaacaggcctatttctctttgggagaagccacggagaaacgaaaagaatggaacgtgtgtttctgcccagatggcaataaaatgtagggtaaatttctgtcttttaaaactgtattttttccatccctctgtatatacacatatcctaggactgttataaaatgctgcatgcgtatgtgaaaatggaaccttattgggctgtttgatggacctttaaaatatatttgttggtttggggtacatactagctatgcaatataatccgcattatttcttatgtaaacaatggataaactgtttcacagtccagacatttatttggtcactgtttgtagaatgtctattttatttacttctgaatttgtattccagagatctgccttcaatgttggatacttccactgtaatattctaggagatgctcactttctttttcagcatctgacacagtaccatctgcctcctcttttcttgccacaagtaataacaattttataaaggaggatcacattacagaattataggtggtaaactttctaccaccagatttacccaagaacctgaaacacattttttcaaaaggaaatagaatgtccttcttgtgactacatcggaattttgcttgcagcattatgctttttttttccccctagtgtagctagccatgtggaactgaagccattagccagctcctcatcctataaatgctattacctgggaaaagaggcagaaaatatactctcttctccagttagagtctaaaggaagagaacaatatgggtagttgtgtttaccacaaattgatagaactcctttattttaaatgctaaaaccaaataacttgtttatatgacttcaacattgactatcacacactgttgcatgataacagagtgaaaactacctctattggatttaagtggggaatctatgtctcattctcattctttttttactgtggaaactagttgattccaggatcagccttagctccaacttgccacactttgagttttggtttttcacttgcattgtcacaggaaacttctataggataaatcgaggaagattttactctgcaacgtgttgcagaattaaacatttaaagtggcaaaaccttcgtgtgtaggttgtctccccagagaatgtaaaaatgaattgaaggcagcacctaataggtaaacgacagccaatcaaacaagaacaaatgaaatttgactggcaaaatcaaattgaaaatgtataacgctgaatctcagaatataggaggatgcatagaaactaagctgtactattataaaagtcatagccattgaaaaataatgactggttaatttggttttctttacctcatggatgtgaatggttagattttgatgttggtgttatttgacgtgtgtttgtcaagaagttgccttagtcggctcgcatttaggataaaaaaaatattttaagaaatgtttaagagattatgttggagacattagaaacaaaataattatgcagagggcaggactatcaaaatataatagaaaaattacaccgctcttttatgatttcctcctttttggcatttaacacaaaactttatgattacacacaccacgcactccagaaatgcttaaaggaagatgagaggaaaattcaatagaagtagcaggcatttctgtgaggacagcagaatgatcacttcatctctgtattttttttttttcaaatttctgtatctgtacaatgtcttttccagctctaatattctgtgatttggtaatttccgcactcagattttctttaatgaattttgtatgatattacctatttttataccagatattacctggctctaatttctttttcaccctaggaaataaaagtatcgggtgaatttcccattttcttatgttattgatacaggtctctgttggatatccccacgattaactttcctgcagcatgttcgatggtggcttaaagaagaaaccatgtatcagagccccttgtctatatagacttttagataaagagaaatacatatcacagaattattctgggcgcatagagtctctaaatgcaaaaaaaaaattgtattgtagctgttgattcttctcagatagattgagtgtagagagagagcattccaaaaactgagcagaagaaacacagtctgaatcaaataacatgaaattttagctaacaagtaaataacacttttttcagaatatgcaaataatattggtttattatgaaaaatgtataggctgatagatgagcatagagaaaaaattataaatatcttctttaatatcactttccccagcaaaccacttttaacattttgatacattttcatgttcaaacatttcctaatagtcttttttcctgttatataaatatgaattttaaacattcgtatgtttatgaaaaggcaataagatactgctcttttataacaggctttctgaacttcacaacatgcagtgtattctaacatgctccttgtgttcttaactaataaaaaacctcacgttatttaaaaaaccatcttaaacataattatccattaagagaagaggttggggtagagagtttcagactatcaatatcaaagttatattttctgtaagtattttaatttttaagtgtagctataggtatatgattataaaaccaatagcagagaaaagataccacctttgaatatagttttccttggttccatgaaaatggcctcctttctttttgccagtccctcagtatcattaactcatttttctgtaaatgccatcattgtatcacatgtcctcaggaaaaggcacttttctcttttaagctagtgtttgttcttgttctaattttatggcaatttaacgagtaacaatcctgtttctataaatactgtttcctaattaatctattgcattctatccatgagaatttagatgactttctttgtaagagaaatctctgtagcatgagattcttctttgctcttaaatttcattctttcacatttttaaatgacctgatagtattttgttgtatttgtgctgattttttttaaccaatcttaccttgttgaacatgtaagttgtttctaatatttgcaatgatcaaaatgtggatccaacttcactaaagcgttaagaatctaaaacaaaacaaagaacaaaaagttggctgtcatcttgcttggaccaccccgtgagttactattttcttgtttccggtcacagttcatcctaaatcatttcagtacacaaaatgttttttaaagtttgggacagggggtagagaatgtcaattattcctccaaggcagtcatatgagcattgagtatcatgtggaatagttgttacttgtaaagttatggggcatcaaacccagtcaatatgtttctggaattgaaaaagtccctggacattctaatgatactgttgttcactttgcacctactgttaccactactttgatctgtcaacactgcccgtaatggttaattttgtgcatcaacttgactgggctacaaggtgcccagatatttggtcaaacattattctgggtgattctgtgcaagtgttatcagatgagattaacatttaaattggtagactgagtaaagtagattgcccttcctaatgtgagcagacttcatgtaattaattaaaggcctgaatagaagaaaaacactgaccctcccctgagcaaaagggaatcgttctgcccgactgccttcaaactgggacatgggctttttcctgccttcagactttaaccacaatattagctgttcttgtatctcaagtctgctctacttcgattggaactacactatcagctctctcgggtctccagcttgcttgttcaccctgtataccttgggagttgtcagtctccatagttgcctccataattgcatgagccaatttcttaccacatacaaacacacacagagacacacacacacacacacacacacacacacacacatataattatatatgtgtgtgtatacatattctcttattccttttgtttctctaaggaaccctaatatactccttattactctttctactgccttagagatcttcaaggccaagagcgtaatcctccatcctggctctttttcctaatcattaatgatcaactcatagccatttagctcaactaaaaataatttgttcatgaagctttacactcccacatactgaggaacgtggtacctaagatcaaacagtcactgcctcatcaaatgcattcctcttcaaccccatacaaatgtccccagatggaactcacaccataaaaatattagatcccattgacttttctgctttctcaaggatcattgcagagcttgaaaaagatggctcctccctttgcctaagcaggttaacttggtgtaaaagtacatgtaagatttggcacaaaggaaaataaatcagttttgcctgggtcctaagaaacatttccctctgcctcatggtaattgtacctgccagttgattgcattactcaagtggagaccatgaagtgaagtggtagaacaagaagaaatccctataattttattaagtatggtgaaaaatacagatatgtagagaaatgactgggattagatggagcaaaacataattcgagatcctgatacaaattgtacttcctggctcaagggagggagcagaacattccctgctacatgggaataataataaatgcctgataaaaatgcagatatatcatagactacagaagctgaagtggattcttatggtcccctactcagacagcctctccttcagatgaagaaactgaagcacagaaagctcatcctagtgtttcatattgaaaaacccattcaagtctattttaataacctgttaccaaaaatgagggaaataatttaactttaatgtttcactttgcattacccttttcctgactagacttctatccttttcttgagttgagctcattaactactatgaaattatggttatgggtagaggttaattttatacctgtccatcttctggcatcttatttacactaaaaatcatttttaaatggcttcattttaaaaaatattatttcagttgacattttaaaagacacatcatttatgtactacagaatatgcattttatactctcctttattaattttattattttccaggtagaccaatcaaatgaatcagaaattcttggttagatctattagacagcataagtatgtttttcatcattaaattaagatgaaaacacaattttactttaaagtgtttgacgtttccagcctttataaagtcaacacttaatcacatctgaaatttgcaggaaaaaattttgaaagccttcaattattaacattatttcgggagaaaaagccactttgccgcagaactttcacttttctctcgtgaattaagtctgatacaaattattcattatggtgaagtttaaacataatagagtctagctacttccacaaaaatactattcaatgagtttctacattgacatctaactgaccttgtaattaatgttgtacacgatccttttattatatgctggattatcaaatatgacttattagcagtataaagacacaaagttctgaaatgtaatttatagccatgaaaaggaactgagctttgtgtgacagttaaatttgaagagatcaggtgattattatgaagcatgaataataatgcatattaaactcacgtttttgtttaaatcattaatatgattgttttagaagaaagtctacctctatcatatgggcaataaaatgtgtataagagcaaacatttgtgtatgtgaaataactcaaattaaaaccagttttccacattaattcttacagtttttaaaatttaaatcatttaatgtatcacacatagctttattcattttaagctataaatgttacaatttctgtttaagctgttaatataagctttgtaagagcaattctgtataaatatagaattgtcattattcactaatagctaccatttatttagtgcttgttgagtgcaaaagtactgcactgagatctttgcatatgttctcttaatgttacaattcttacctgaggcatttctgtttctgctggaatatggtctctctgaattgaacaagggaggcatttttggttgttatgatgaaaggtggacactgctggcactaacgtgtgttggtaagcgactagactcttcatgatgcgtaaacagtgtttcctcatacccctgcacattcaaatagaggaaaaccttgtttatagttaatttcccctagaatgtaaatccatttaacatataaacacaaagcgtgttttgtgtggatgttttttactggagcagggagacaggagaggaaatgcagttttgatagttgctgaatttttcaagaatgcagcaattatagaacaatttctagaagtttcctaggagctcttttccatagcagaaaactaggacttaatagccttgcgactcatggtacttgagtgttccatacaactcacctatattcaggggacatttgaaaaattctacattaaaggggattcttaacataggcgcaagtgtctggcatcttcaataggtcttctggtgtggccatgaaaacattcacacgtttcaaagtattttaaaataaaataaaacatatattgttgtgttatgaattattttctttcttttttatatgatggttagatcactgtgcagacaagtttatgagatctattcatttcatttcagggtggtaaatgagggtgttactaaatgttggttctaaaaagggagacattgggtattacagaattcagaacagctctaagccctgtgcacatttagcattagaggacacaggcaaatctggcctccagtcctggcagcttcttcactatgtatatgatgttgggtgggttgctttacctctctagtttttacttttatttctaagctagggctattcatagttctttatcatgtggttactgtgaagtagcaaagcacctgacataattagagcagataaaatgctcaacaaatattgcttatcagaaggattatgtattacctcccgaaatacatcaaaaatatattttccaattcaaagaatatgtagtacaaaaatcatgcctaaattaacagagttgcagtagcccaaggagagaagataatcattattgatttcttcttcctttttgctaagcagttctctgtctctgcctcctcagttgttgtccatcccactcccccactcccaagccctgaactctgaggggtttgctgccgtggccggttctgtagtcattgctgtccaatgatgaaaacacaaaatactgcaacagaacactatgcctgtcagcttagctcccttctttctgctaaatgacactcaatcctattcttttgttctaaaggatatcctaaatgaatagccactggggggaaaaaaggttatataagattgtgcactgtgtgaaactgatgcaaccagatcaatgatgtgaatttctcttaactatttactgggatctagaaacaggtctctcaacttagcagtgtttacgaatataataggccttccttatacatacatctgaagccaatctgagtcaggaagagtcgtggtctgataaatattttgaaaacttgcatttgttctattaaagcaaactgtttattaatagtgtgccttattttttaaagcaaaacatttataaacagtagtcattacaggcacttcagtgtacggagtgatcaattgttagacctttaggaatcgattgtttcgtggagcttcggcttataattgaaatgtcatcagaaggagtgtaagacatagcttcaggagaggccatttatgcgcttttgttttcagctaagttatagagtcatcatgtgaagaaagattcttctcttagtaaaaatcctttaatggttggaataacacttgatatttaatatttctttctactttatatccacatttattcaagtgctaacgcgtgtggggcagcaatgaagcactttattccaacattatagttctcatatctgcgtatgattatttttcatttatcgttagcatatatataatgatgacttttaaagtacactgtattatattcactggaataatgattagctattaataatttgaacactatccaggaaattactgaacatgtcctacaagataaacctcgtatgatattgtctccaaataacagtgctaaccaagaagagtgctaccaagttcaaaagtaatcacagggagtaacctaaatgcagctccgttgggttaaaaatagtttctctaaattatatgttccctaagtttgagatcgatttctacaaggggataaaatgtttttataaattctcagtgataagtcatgtgattaagaacccccaactttttttccaaagacatttgcatctctgatcaaaataacaagatccagtcttagttataaattggggaattttcatcaaaataaggagctactcgttgcataagaagactagtacaacttaaagccaatttaatttcaatgaatgcatgatcagctccattgccaattgagtgtttttcttattcatcagaagatgggttcatcatcgtgtttcatatcaactgttctcaaaccatattgcccatttaaataaatatagatttgtctcgaaattctaaattcatgtcatatttcataaatagcctatggtcctatttattactttaaaatattatagatataatatttttattctaaagtaactgtgttatacaaccaaattattcatttaaatatgtgactttttaaataagtaaatgacttatttaagtaaagtcattaaaattttccagtctgtccttcatccacctgatctttgaatgagttaggaacaatacaggaaactaatacaaacttaattttgattacaaaagatgaaatcattctgttatttattcaacacactatgtgtcaataaaatcttatactgtgaaagaattcgtctaagtccatttgctgttgcttgtaacagaatacctgaaaatgggtaatttacaaagaaaaggagtttacttcttacagttacggaggctgagaagtccaaggttgaggggccacatctggtcagagccttctcccatccaagtactaaccaggtcgaacctcacttagcttccaagatcagataagagtgggcgcgtttaggctggtgtggctgtagacttgttagagcctttttgctcatggggacacagcagagccctgaggcagtgcaggacattacatggcaagaaggctgagtattctaatgtgttcatgtctctcttcctgttcttataaaatcatgaatcctactcccatgataacccattaacctattaatttatgaatggatgaatccattcataagggcagagccctcatgatgcaatcacctcttaaaggcacaatctcccggtgctgccacgttggggattaagtttccaacacatgaaatttgggggacacatttaaactatagcaaaattgtaataaaatgttatatagaagcaatgttcttactgattataattgttatattggtaaagtgttaagtcctctaaccaagggatatatttcagcttattataatagttttaaatttacaattcaatatgaataacatctggtaaaagttcttttcaagaaatgggaaaattagaaatgtttagaagaaaataattcaataaatattaagttcaaactggattcatagtttatgtgaaattctgggaaccaattgcaaggggagaaaatagttacaatagcaatggtgaggatgagaataagagcaggtatcaacgttaattgagggtgtgttatagttctaatcgtgctatgcccactacatgacttttccctgtgtgaggtttccgagcttcttcgtagtaatcctaaattgagctggagagaggctagggtaacttactcacgctcatagagccatagagtagtaaaacctgtatttgaactctggcctgtctgacatcattctgtggtcttttaaaccaccactgcttctccatattaaaactccaaatctaggtgaaaagaagaaaactcagaacatgttctgcaacaaaatataacaaaatataatgtatataaacacttatacataatatcactaatatctttactatgaaaagactctgatacgaacattttacataattcatgcagaagtgttaatcacattgtctgtgatgagctgtgtatgtatctgataaaattctggcaaccagacatcaactcgtaggcatagatctgtaacactaaatatttgcctcgagaaacttaaagaaataaagacaaatgaatgaataggaacatggaactgagtacaagataaaatcctcctaaagcaatcgatgtacttgctgctgcgttattgttctaagcaaaagaagcatggcgaagggagatgtgaagctaaaaacagaatgcttagaaggagatgatagcaggagggaagcaaagatgggaccaagctcccaaaaggcgggctttgaacaaacaaaacagaaagctaagcctttgacggatgcacgggatgcaagaaactttagtcaggaaagaggaggcgaagaaaaaccctccaaagaaaaggtgaacaatattttaataggcaaattgacagatagcaagagatatataccatgctatgttttctcattgcagctgaagacaaactggggttatttatgctttgaaaaagcgtaaatctaaaaaacaattgtggaggaagaagcgatgaaaacacgtgttaatacagaaaacatggctccaaggctttaaacttccttgtgagataaatgcatttacattttccgtagtagctaatatatatatatatacatatatatatatatatctgggaaaataatacacagtgattttctttctttttttcatctacttatgtgagaaaaaagtaggctatctgaaagcttttcagttaaatgaggaagaaagttaggtgatcttgtaaataatatatatgttcaagataatgtaaggcccttgtgtagttttcaaaacttatctttaatagcagtttcttctggggatggggtagttcaaagttgaaatgttagaaagatgttaactttttttcctttttacttctccctttcaggatggaattaacaaatttgattacaaatagatctcagagagaggcaaatgcattgaatccagaagtaacataaaattagatcatgtttagttatgcccgaggtcacatggtgataaaaatgaggataaactgaaattgtctgtgagccagattagtttattttatgccagtcctaggaaaaagacacatcatggtaggatacatcctttttttttttaattatactttaagttttagggtacatgtgcacagtgtgcaagttagttacatatgtatacctgtgccatgttggagtgctgcacccattaactcttcatttaacattaggtatatctcctaatgctgtccctcccccctccccccaccccacaacagttcccagggtgtgatgttccccttcctgtgtccatgtgttctcattgttccattcccacctaagagtgagaacatgcgctgtttggttttttgtccttgcgatagtttactgagaatgatgtattccagtttcatccatgtccctacaaaggacatgaactcatcattttttctggctgcatagtattccatggtgtatatgtgccacattttcttaatccagtctatcattgttggacatttgggttggttccaagtctttgctattgtgaatagagccgcaataaacatatgtgtgcacgtgtctttatagcagcatgatttatagtcctttgggtatatacccagtaatgggatggctgggtcaaatggtatttctagttctaggcccctgaggaatcgccacactgccttccacaatgaacagacacttctcaaaagaagacatttatgcagccaaaaaacacatgaaaaaatgctcaccatcactggccatcagagacatgcaaatcaaaaccacaatgagataccatctcacaccagttagaatggcaatcattaaaaagtcaggaaacaacaggtgctggagaggatggggagaaataggaacacttttacactgttggtgggattgtaaactagtacattcttaacatcaatttattcctaaaagcaatgttcatagggcacactgtaggccatagatttgcctcacaaatttaaaggcctaagccctcaacatgcacagcagtatactcagagactatttgtaaagatgacgattctggaactttttaatgaccccaatcattagcaatgattaaaattaatattcaacattctatatttaccaaggcaataaagtagactaatctattttaaaagggttttaaaatgaagagatgaaacaaaccaaatgattttgatttaaacttcatgaaaacataagttgcattaatcaggtgattttgttttatgagcattctgattgaagtgatcatatttagccccgggagaataagagaaggtaaagtatgggtatggcactgaatttactgagatgattatattgtttgagttaaagaacttgtattaagaaacaagtatgtgccaaacattgtgctaggagcaagcaatgctaaaattacatgggtagaaagagagaatgaaatatctagaatgagttagaaacatcagtgttttccaatgtggagccctgacttcacatgaaaattctcattttcaaacaaggtagtttatgaaaactggactattagcaagacagggtgggcatgccatcagtatagtacctggtgtaaaactagaaattttaatcatttgtgctttcattttataatcagtaaaatccaaggtaggacaaacttttactttttctgtataatggactgatatttgaattatacccaactttaattttttgccagaaattatgctttattgtttctctaaaatggtactatagatctttatttatttctatatatttatatgatttttacatatatgtgcatttacatgtatatacatccataaactatatacatatatacacataaattacaaatatgtgtacctacgtacatatatatgcatatatcacgcaaatacaggcacattttcaatacccctttttgatttttttccttgaagagcatagcatctgaatttattatggatttatttttaatttatggtcatgttctttgagtgcttttggtgtttatctggttgccccaaactcgctagcattgtaaagaagatgtgcaaagcctgaatctagactgactttcatattgactttattagtcaaaaaaagtagatgaaaatgtaacagtccgtgttaaaaatgggaataagacagatgttcaagccctagcttcagcagtttttagctgagatttactggaagaaaacattttctgaactgtaaaacatgcaaaatgcctacgtgacagacttcattaacattattaaatgctatgatatagtaaaagaatttgtaaactgtcaagtgctttgtcaacattaggaatttagttattataggtatttccatatacatgttgtatttagaattccctttaattttatacttagggttgatttgtattttaactaagtcactttatatatctggtcccattatacaagtatacttttccttaggataagaaagtgatctttatatatgtttatcaacccaaatgcccatcagtgatggactggataaagaaaaggtggcacatacacaccatggaatactatgaatccataaaaaagaacgagttcatgtcctttgaagggacatggataaagctggaagccatcatcctcagcaaactaacacaggaatggaaaaacagacaccgcattttctcactcataattgggagttgagcaatgagaacacatggacaccgggaggggaacatcacacaccgaggcctgtcgcgaggtggggggcaaggggagggagagcattaggacaaatacctaatgcatgcggggcttaaaacctaaatgacgggttcataggtgcagcaaaccactatggcacatgtgtacctatgtaacaaatctgcacgttctgcacatgtttcccagaacttaaaatttaaaaaactttaaaaaaagaactgtagatactgatccaaaaaaaatgttcattaatgggggttaaatgattatttctaagtagactactcttgaacccttgaatctttaagaattttctttgctattgaagccattcaaactctattttattaaagctgtcgttattctagtagattttaaacagtaatacctgaatacattagaaatatgcaaatctgcattacatatggcatctgcagagcagaggagtttggtcatctggactcatgctaaagtctccgaaaaatccgcttgtcttaatgatggttgactcgctaatgctatgcgtatatagtcttattttaagtgattgaatgatgtggctaataacccctctgttagatgcactcagaacctcacctacctgggtcctcagctctccagtgaaatctctactttaagtttattttctaacatggtaagagccttcagtttatgttatgctcaggcccgtcactgtgaataaaatattagaaatggactttttttttttgtatttttttaatggatcccttggaactttaaaaaaattatttatttgagctttctactgttatcacagtgtctcctaagcatggcctcccgttttttgttggtaatataattcttacgttattcaaattagtaaccattatttttctcatggctagaattctggaaactattaggaaatcactgagcataattgaatggctgtttatttgaagagctatgtcaaggcagcatagagttgtattttcttgcaggggctctggagtcaaagagcctgggttcaaaccttggctccaccactttctatctgtggggcattgggcgtgttacatttgtgaaacttttgtttctccatttgtaaagtgaggtttgggggatgattaaaccagataactcatgtgaaatatttaatggaaatgtatttggtaggggatttattatttttaaatttggattgcacatgacacatgtcagggatcatgctatgcattttggatagaaagatggctaagatatcatgcctgactcttaaaaacttacctaatggtaaatgacgagttaatgggtgcagcacaccaacatggcacatgtatacgtgtgtaactaacctgcatgttgtgcacatgaaccctaaaacttaaagtataataaaaaaaaaaacttataatcaactgtagtagaaagagatctgaatggcttgccatttagctaggcacatggtatatgtgcttaattcatactagcagccactacagttgtcatgattaataatgagcttccaactgcacagaatgcttttaatccatagaaaatcaaatcagaaacaagtttttgtaaaattaatgtgaaaggagcaacaattaaaatgcaagattgacatttattttctaaattggttctattttctttcacatttacaaaatttataagaaaattctttatttctatgtgatataaagaactagaatgtactttgatgtgaattattgttgccagtgctgttcaacttttatccataatttactaagcacctacatttagacaaaggcattatccatccctttggggaggatttcagatgattcatacacagacctggtctcgaggaatttaagattttctttggggagggaaataaggactttaaccaactcaagagtacttagagaattttctgaaaataattttatcaatgaaaacttgttatattaaaagaaactgtcattctgacttccacaaatctaggcttgaaactatggataacgagatattttctattactctcactcacgtcattttcacaaagtgaaaaggtacattttaactagtgaaagaatagaggaaatggaagtagctcgaggcagtggacgatgattcaaaaagacagggccctattatttgatcaagttatgcaacgactctgggcctgtttcttcacctctggaaggaggaataatctccaagccctttcagactcttttggtaattcacctccagcacatcttctaaatgccagcattaactgtcctctgatttgtctcatgtttttctagccccatgctctcctgttcgccatttaccctcatgcaaggtacaaattacacccatcatcacaagacacttgctcaagtcccattgcccccttgaagacctgccacacctactctctcaaaaaccatcatttcctgaaagtcctatacagctcatttggtatttacagtgtactgccacaagccactaagcatcgttttgtgaatacatgacttacagacttagcttgagtaaagatacttgaaaatgaacaccatttcttggctatcttcctattttgatgtacccttcaggcctatgaattttagtataatagataaccaataattatttcttggttctttcctgcacatctgaataaccctatgcaaagtgatagaatgtttttctataaggaggtcctacactggagattgtgtatttcttaatgctgttgaaggaagagatgtgtatctaaaataaatagactctaacaaacattaatttatatttctattatctgttttgtgtattgagatatctcacaaaaataactaaacattttggcattattgatattacatatttgccatgaatatttgtaaatgaagaaaaatatatatacatcagtaattatcttggcaaactcttcaattatgcaatattgttacatagattacatatctaagtgaacactggagttttaacaatattgtgtgttcataaatgttttatttattattgccactaattcttattgccatttcaagaactatgtataagttgttctaaaaactattaaagtataggtgaccatggtcactactgcctactttggtaaaggccaaatatgtgaagactttttaatgtgttaacaaacgttgaaggttttttaacctgttaacaatcagtaggactcttgaaattatttcctaagagagtaaattttacaacttgcaaagcatgattaacctcttgtaattataaaccatctcttgtagttatgtagcattttgttaatgagcaaagaaccattgtggttcctttttacatttcttaaaataattctccgtaacctcattgatatctccagtaaatttagataagcttttttttttaaaggagggttaaaatgacattttaaactaatttttcttgttagttatacagagttgaactatctgagggttttattgacagtcataaaaaatttgttattttctgtgaaatatagagaatttaattcattatcatattattaattctgtgggccattgtcttaattctagaggcacaagctgttttcatcccactgaaatagaggaatcaaagtatgttccttgctcaaagcacaaaagtgacatactacatagtatgcttcttgagtagtcgtaaatctcatgtgttaaattacatcccaaagatttcagtatgttttatgactttaataatttatggtaatttctaatctggcctttgttgacctgtcttgctttttaaatttttagtttttcgacaaaataattaacatattttaataatcttccaaaggtgtttaaaatggcattgtatagagatagctgaaggcttttgagcttctgtgttgtaaacactttcttaataaaacatgaattgctaccagatgatccagcaatcccactactgggcatttatccaaagaaaaggaaatcagtatctttgaagagatagctttgttcccatgtttactgcagcacttttcatactagccatgatatggaatcaacctaaacgtccatcagtggatgaattgaaaagaaaatgtggtatgaaacagaaattgctgctttaatttatattaaacacactcatattcttctcagctgttaagtattgagttatagatttaaagaattctattgtgaagactaaagtgactattaaagtaagaaattattttttccattatatttaacttatttcatactttaatgttagcgccaatgagcaagactattgaatacaaaaactaattaagtagtggtgatagtacagtatataagggagaacattcttttagaaaggaacaataacagggagcaatagaaacaatgaatgagtgtaaggtcacttagtgttaaaacagctaaaatatagtacaaataagttgcgttttaatagtgattttatataattacaccttgatgttttatttgttacaagaattgtccaggaagatttctctaaagaccaaaggcactcttcccctaaataactccaaagccagtcctgtgtttctataaaaaaaaaaaaaaaaaaaaaaaaaaaaaaaaagtgaaaataacgtgatgaacatttttgaggaagtataaaaccaaaatactccactgcatagctgtttctgcaggtattgtattgatatattacattattcagctttggagtctccacatccaatgttacatcatcactctaaattaaacatgtatagataaatgaaataaatgagatagcatatgaaaatctcatagcccagcccctgcactatttaaaatagaaataccaaagaattgtattcctcatctgaaagctatttagtggtggtgtttcaaataaaaattccatctactgctgttgcttccattgtatctttttctctgcggtactgaaagagaaagagacccagaaggggccttgtctgaagtgtccctcttttaagctgttgctgctttaagcacagggtggacaaatgtaataggagtttcataaaggtggaataaaccagcggattacggtgtgggtgaatactttcagatgttaaccaggagctctgcttgcatgctgggagttgcccatgcctcttctagattgaggcacattatcatgcacaacctaactccaagaaatcttttaaaccactggaaattgaacccagaacatgtctctaagccagccttttcatcctgacaccgaatcatagcatgagccagtctgtcagggatgctgctgctctctaggcaaattttaaatgttgaaataatgaatcatgttttcttgaaaaccatgtacaccaaagaaaagttagtcattttatagatgatgaatattaacattttcttagacaatctgataaattatcagatctcacttttggctctttttaagacagttatgcctcagaaatattaataaacccccaagcccttatactgatcagtatgttcactactagctatgagaaattcttgaagttcttgtaattattgtattatttccttactttcattttattagtatgtgaataatatttttaaaaattctagtgtatgtcttgtatatattttaacaacatgacttttaattaatgtcttgataacatttcttctagtgtatgttttcagtaacatgattattaactgtaactttaaaaacctgtggattagatgggaccattttaaaatgttttaaacctggaaaatctgatggctttaggtttagttcaagctatagatcacctgtggagaatggaactgccaaaaaaaaaaatagctgtagcagccctttgagtattctaaaatagggatgttatccagagcattggtttctaaagcttccattatttattgatgttgagctttcaggatttagctacaatatttactcaacatctaagccatgcttttttatcagtcatgttttatatcttttataatcaaactgcttatcactgaaaaaaatatataagtttctatgtatctggaagaattctctggtgtttcttagatatggattttgatgtgtggaataagaattcaattcaaggataacagagatgttgtcctgaaaaaaatcgaagaaaatcagcttttctttaacattctgtcaaagctcctgactattagtttatcagcactgttttgccaaaggtgtcttctcttctcttctttgaaaaaaatcatctgctgctgctacgccgcaagtgtgttcccgctgtgcctgagaagatgtgtggcataaaaaaatgggcatggcctgagttaaaagtgctacatttaagccagagctggcttatttattagttgtctaatcataggaaaatgacagagcatgcttttctcttgcaatatccgttgctgaaaattaaacacatgagcagagctttcagagaggttgactggcctctcagacagcacctcataggatggcctgtgttgaagcatctcctttaaccagggtctgtccctcagcattgggttggctcacctagattggattgtcccagcagaaaaaaaaaacccaaaattcagaatcatatccaaaccggaatactctttcattcacattacttgtactaccttttcagaaactggatacctgagtgtgtgagggtaacttagaaacttatctcatggttagaagttttagaattagagagcgatgatcatgaaacggacttcatgatcagaagcaatggagcaaggaatgagatgtctttgaggagtatttccctgaggctgtggataacgctgacgaataatccccaccttaaaagtgggttgaccactctagtagctgtaaggtgggagggttctttcttcagagataaatctgtgctcttcacttgcccatttcccaggttttcatgtaggtagaagaaacacctgtaatctgaagacactcttccttcagctttgttagtgacagggatttaaatatgtctttcacacattttccttagatagttaaatttcacttttcctgtttgtttttctctgaaggtattctaactcccctcctaatggacttctagagctttctaattctatgcaatttctgttgatttgttctggtaaactttgaaggtaatctctgattcaacttcttggagattctatcatgtcatctctgtttattaactttatgttactcatggtttcttgatgaggactcattaaacataatgtaagtagaaaattattaactacataatatttactacgggttgttatttctgatagtagctagctgtaagattccaattgttcttcaaatctttgtctcagtgatctctgtgtagttcttgactacttcaaataacttcctagaaggatagggatttaataatctcttaataggaacacttaacacactgctggtgggaacgtaaattagttcggtcgttgaaagcagtgtggtgatttctcaaataacttacaaaagaattaccatttgacccagcaatcccattattgggcatatacccagaggaatagaaatcattctaccataaagacatatgcacgttgtgtatgttcattgcaacactactcacaatagcaaagacatggattcaacttaaatgcctatcaatgaacagactgaataaagaaaatgtggtacatatacaccatggaatactatgtggccatgaaaaagaatgagatcatgtcctttgcagcgacatggatggagccagtggccattatccttagcaaacttatatggaaacagaaaaccaaatactgcgtgttctcacttataaatggaagctaaatgatgagaacatatggacacaaagaggggaataacacacactggggcctactggagggtggaacacaagtggagggagaagatcaggaaaaataattattgggtactatgtttagtacctgcgtgagaaaataatctttacaccaaacccccgcaaaatgcagttcacctgtatagcaaacctgcacgtgtacccctgaacctaatttaaaagttataaaataaacgtatcttattttcagtacaatacaccacagagtagaagggttaaaagagattgcttctgaggaggtgagatgggggtaaggacagcacaagagcattttggggggtgatgaagctgttctgtgtcttgcctgcgatgatggctacacgactaagcccttgtcagaactcacagaactttacttcaaaaggagcggattttactacacatcaattccaataacaaatactttgtctttaagcaaagggatacctaaatatagcgtattgaatggatctccagaaaaacacatttttcagttcatgtttcagcctaggcctcatctcatccaggaaaccttgtcttgcttgcctttacatacatgtggcaatcagtagtttcttttagggctcggactgaacactcaatgaacttcaatcttagcgcttgtcgtagcagattgacatggtttatttatatgtgtcattctctgtagtaaaaggaaaggatcaaggccattcacttttgtagtgattgtgcatggcagtatttggcacatagtagattattaattatggaacttctgttttcacacacacacacacacacacacacacacacacttcagagctattttcatttaaatatttgctttagtctccaaagcccctctgcctcaacaccaacccttctatctcattattcatcagcttttctcctattacgaaactacttaggaaagcccacttatttagcttatgatggcaaaaataaatatttgtacttttttttttttttttagtcatcgcttcatagaacagcctctgtcctctgcttatgccatgtctgaatatatgctggaggtaaaaagagttcctggttgagagcttcaatttgagaaactatctgagattactttccaggttccaccgtggaacctgtctgaccttgaacaaatgacctcgaacaagtggctgaaatctcttctatttcgtcaactgtaaaatgggggaaaaccatgtctatctcatggggttcatgtgaaggttaagaaattgcttattcagtgtttagcacagtgcctgatatgcataaagctcctaggaatattagctgttattgtatttccttaaagaagcccatagctctatatgccctttcattatatgttttagtagcccaatttaacatatggataaaatatttttaagttaaatgatttgctaatggattgttgaacgagtggcagacacccatattatagacgaaggtcaagtccataacatacagtacatttccccactttcatttcccattaccaaaattcattattctcctgagaaactcattatagaattcatgtcagattcatctgtgtgttcccagcagtgccttatatccagaaataacactgagtcattgtctagatgtagcagaggtggaatcctccaaagagaagcctcagagtggccaggtttgccaagtatagggatgccttgattactggccttactctttatgctcgtgaattcctaagttttattcctcctgtagtcatagattggcttttaagctacaagctgaagagagagaaaacctcttccacctcgttggaatatgtctcttcaatccatttgagccaatttaggacatgagactgctcttagtctagaaccagtcatcaggagaattccaggtctgattgactcggactagcgggtcaatatcagggcaaaaattccaacgcacaacacgatgtatcagtaaggagaacctcaaaattatttcttaacgtccagatcatgttcctatttttatatatctattttctcacataagtcattaaaatgatgtacctgtgcgggtcctttaatgatactcaaagatcttgaattataggctaataactaacttaataagctgcagaaattaacatttctgctacgtttatgtagcattttcccacatgtacttcagaggcttgagaaaagaccctgaaataatgactgaataacagctttactcacttaatttcaaatttgttaattcttctgggaaataccgtcaacatccattttattatttttctcaattacatgtacgtttctacatcagtggataagttaaggagaagaattccctcatgataattttttcatgctcgaaaattttgaatcaattttttattttacattatactctttcctagtcattagaaagggagtggtggttaagataggcaagaatgctttataaggatactactctcgtttcaattcttaacatcaaaaaccttaacagtgtgtagactataaaataaaatatctagggatcagagcattgtgctgaactttgcaggttttttagtcaataatatatatgacgtgttcacagaattctttgtcaacaaagtacttttggagctccaggccatttaagttggtttttgtactttttctttttcttcggaagactttttttgttctatttacctggaagtgtttcttttttggtactgtgaattaaaatgagaccaatctactaggcaggaaaaaaccttaattagattgttgacacagacaaataagaatgtcaattagcatctactgtcacatgcctctccagactgcttctaggatgagtggcctcaagcagctacatcatctttatactcctaaagcatcaaggaaacttggagtgacaattcatatcatgaacacatccacagtgatgatgattgtgcttcttcccccccacccaacaacaaaggatgaatgccaattaatgtattcagttttttgcgtcaaaggctggatcacttgtgcaatgagggtaatcatcctgaccagacaggccatacaatccatattgtgtgaattaaagataatatgcgtgaaacaccttactctggatgtggttcatagcagtagcaaaaagatgaaaactatggtatgctaacattttagagatctgtactctattttaaataattttataaaagtgcatatacaataaaaagtgcacgtatcacaagtatatgcctcaaaatctaaagccagtcatgtaatcagcatccacttcaagaaagaaaacaaaacagtacccctggttcctctttgcaatcattagtctcccaagagtaatcaccgatctgatctgtgacagcatagattggttttgccctactatatttttgctgaattatacaatatatgctctttaatgtctggcttcttagtgcattgtatttgtgtatcagctattctcttgtgtgtagttattaaacaatcattttatgggctgcataatattccatagggtaaatataacagttttattgataacttagctattacaaatagtgctgttgcagacatatattctattacatgtcttttggtataagaatttacacatttcacatgggtgtatacccagaactgagattgctaaatattggggcacattgtatacattttgatttagtagataagatattgccagatatcgtaaatgcacagtttgataaatatagagatttatactttttctagagaaaagccatcaatatcagtgtatgtgtatatatatacgcgtgtgtatatatacgtatatatatacgcgtgtgtatatatacgtatatatacacacatatatatacgtatatatgtgtatatatatacgtatatatatacacatatatacatatatgtgtgtgtgtatatatatatatgaaacaactcagaagcagaaagataccccatgttctcacttataagtgaaagacaaataatgtataaacatgtacacatggacatagagtgtgtagtgataagcattggagactgaagtgtgggggtgtgcaagggaatcagtgataaattaatggctacaatgtacataatttgggtgatggatacactaaaaatccaaagttcaccactatccaacatactcacataataaaattgcacttgtaccccttacattcatacaaataaaaaattatttaaataaaaataaatatgtgtatatgtatgcatacatacatatgcatatacatatgtgtttgtgtgtgtgtatataacttacacttaaaataagcatggatgctgcaatgaatgctcaatttacaagggttgtccatccaaacttgtggcaagtatctcacctctcaagttgttttcttttttcttcatatatttcttgcttttgtctaggaaggaataatttggcttgcctttcaagagtgtacagtcagcatgataacccaaacacttaagacacgtgctaacccatgtggatcccttgagagaaggaaaacagtggtccttttactgggcagatagagcccggggccaggtttcgtggcttgaagatttcagcttctctgcgcctctcagctcagtgcctctggaagcaatttacaacttgtgaggccatactcaaaggccctgttattaattccccgccttccgagaccccatttcagaggatctcaattgctctcagagtgaatttactgtttcctgaattccgtaatcccaatagcaggtctgttgtcctcattagatagcttaagttagagtcggcagtgtaattggcaactgagctactaagtatccaatgcttatgtggaaaatatgttccctattgcaaacaactgatattcatattcaatttggcaccatcatctatctataaagcagatactacttgtgtttattaagttttatcccaaataattattttagtaataatgcttgaaaataggccttggtcatttgcatgtctgtatatggcatatcctgagtctttgtatgtattagaaagatcactcgttttgacttgatggtttaataaaagatgtccctcactttgggcagagacatttgaaaaaggcactccaaccagggacctaagaggtgaatgagatgcagctctgaatcaggtcacacggcctcaggaaggaaacatcttggttttcacatccctcacttctcgatgtcatgtgcaatacacaaatgacccctcaacacacacacaggcacatacacaaacacacactcactcactcactgtattgtctctttccttgactaagtccttcttactaactcaagctctaaagcttttttacttacctaaggtgagtgtgtgaggatttgaggtttcaatattaaaattcagaaacatttaaagttcattttaaatattagtaaaaaaaaatcttgacaaaatacaattatagacaaaaagaaaattcagaatatttggaatttaaggttgaggttacagccctatttatgaaatattagaagaaaaatgctggagagaataaagcaggtttatgagtctgatagaaagcataaccagatgattatgcatatatttgcatatgcaaagctttctaggcaatctgaacatttaaacctacaaatgtggctgcgatgaacagccacagaagagcaggctagaacagaagaggaggctagaacagaagagcaggcagaagttgtaaatgaaatgttaattttcaatggttgatctcccaagtactggaacagatttgtgctgttttcaaggttttggttcaaagaatccagtagtgtattgaattgttttgtggcacttccctgttattttgctttgtaagctacctcaatccatgaagtggctatgagccccttatacaacactgttgatttttttttccttatctacgcaaaagatttttgattcagggccaggcatggtggctcacgcctgtaatcccagcactttgggaggccgaggcaggcggatcatgaggtcaggagatagagaccatcctggctaacacggtgaaaacccacctctactacaaatacaaaaaatcagccgggcgtagtggcatgtgccggtagtcccagctactcgggaggctgaggcaggagaatcacttgaacccggtagccgagatcctgccactccactccagcctgggcgacagagccagactccatctcaaaaaaagaaaaaaaaaaaagattttttattcaggtggctatcagactcattaaatagaagccttaggttaagttcacgggttgctagttggaagcctccatggactatgttcataaaataatagaaaggagttatgcaggacttcttgaaatgttatttaaaaagtcagaataggctttctattacttgtctgaggtcaaatacatgtagtgctttctgaccatttcatccagggtgttagctaggacaataagaggtgcttaaaaattattagattgagtaaatgagaaagcccttagaaacataggaacagaatgacccttgctttggatctaatattgactcccacgcctaaatccctttggagaactcctttattttctcttccatcaagagcaggtataaattaaaaacaccattaaaggggccatctagctcagctgaagctttcatcacacatgtaggggaggtatggttgggagggatctttttatcctttaggtcttcaatttacataggacttttgaataatcaaatagccccaaagagctgatcttaggactagttgtaattgagactatttctccatggggtagaaaaatctagttgtaggaaaactgagaagtagatgtatgttaacctcaaaggctgttttttacaaaggatgttaaagcatcatctttgctcagaaagggagcaataaaacaaatgagtggaaataacaaaaggaaataatggccaggtgcagtgcctcacactagtaatcccaacactggggggctgtggtgtaaggatcgcttgaggctagcagttcaagaccagcctgagtaaaataggcctcatctctacaaaatagatagatagatagatagatagatagatagatagatagatagatagccgggcgaggtagtgtgcccctgtagccccagctactcaggaggctgagatgggagaatcgtttgagcccatgaggtcaagtctatggtgagctgtgctccctcctgccactgcactccagcctgggtgacagagtgagatcctgtctcgaaaacaaaaggcatactttttagatgtaatggaatagagtacttccaaacctggctgcctgctggagttgtattggaagaggttgcacgacttcagtggagatggcctagatgcctgctcagcagtcatctagttaaagcaactaagaacatgtaatatgaaactgcaaaaagagatcgtgtacgtaaaatcactctgggctcctcagatagagtaataaacacaactcctgacagccaaataaaaagagaaataatacagcccttgacttccttggttgctttgacatactaagtaggtgttacaggttgggttctctgggaaacagactctaaaacatttttatttttactttatttgttgttattattattattattattattttagacagaattttgctctcgttgtccatgttggagtgtaatggcacaatctcgtctcactgtaatttccgccttatgggttcaagtgattcttctgcctcaaactcccaagtatctgggattacaggcaagtactaccacgcctggctaattttgtatttttagtagagacggggtttcatcatgttggtcaggctggtctcaaacacccgacctcaggtgatccacccacttctgcctcccaaagtgctgggattacaggcgtgagccactacgcccggccagactctaaaataaagtttaatatgcagaatacttatcagggaatgcccactggaccaatacatattcaagagagggcttagaagcaggattggacagaaagagaagttgagctgtaatgcaggcccaataacagccttagtgttaagcaggctgagagattcagcagttaatgagacagtcaacccaaacagttttataggcatcaaaagtatgatcagcatggtgtcagtttcctgtgtcacttgtcccacagtatgataccaaaattaaagagaccagatgacatgcaacacaagcagtgtgcactctgttgttgagaagccaatttcgtcatgcaattaagcagttttatactctgcagctgtactttaaggggagctgagatggaacatcatatgtctcaccataaccagaaaggcagatgagaaatgttctatcgccacctcccacaaggtaagggacttccctaaagatacagaggtgggtggaatattgccttggtagacttcctctcaagactgcctatcttcccatgttggaaggatcacagagcatttgtcaagacgtgggtcaatctgcagttgaactttgtgtatgtggcctatgtggatacttataatatcattgggcacctccatagagctgtttcccaattgaccaaacatatgggaagcttcagagcttcgaatgacccttcagagtagtcctgagaacagtgagccttactactcctgcattaatcagtcattggatgatagccttctcagaaataagtcatgaccttgtgcaagggggctcttcatggctgggaccacccctaaaactgagagctgaaggctgtctgccaccagcccttccacctgctgggacaagttctttattgaagggaaatctgagtagttcatcagcgtccatcacagtagtcaagccgttcattcttccttcttatgacaacattgtgcttattgttatgtaatccctttccagaacattttaggttaagttttaaaaataatgcatataaatagacaattcaaatactggggaaaaaaagcttgcacttatattgttatagaaatgtgcacacttaaagagctgatttcttctgggtatttacataactttatttaaaaatccatccatttttaattagctgtttttaatatgcagttagctaagatattataagccatatattaggctaatggacatttaacagcttagttaagttcttttaatggaaatgctgacaaacctttgtctgtaattatagcaacactgtgattacagaaggaggtgcctctccttgttgtttgcagccctaaaattccatgtggctataagtaacaaagtccattattagataaacacaagtcatacttggcattacttgcattactcgtctccttgctttatttgaatcattttttaaagttgtaaaatgtttttcaaaactcagaatagtggccagttaataatatgattcctcttatattatgagattttaaaaaatagttcaccagtttctggtggcctctatacccattggcaagtcctagccattgtgaattaagtaaacaattctttatggaaattttttaatccttaaaccctataagtttttattcatcatgtcaggtcacttgtcaaagggtttaacattcagaattcaacaaaagtttatcaaacacctattacaggacgtgcaattttgggcgcactgggatttcagcaattaacaatcaagatatgatttgtatcgacatggatattacattctctcacaggagacagaaaacaaaataactagaaaatatacataaagagactttaaaatggggtaaaattacagattgtgacaggatgaccactttggttcagaatatctaggacatttttttctttttttttcccctccctccctctttcttttttttctttttctttttctttcttttctttctttttctttctgcctttcggagtcttgctctgttgcccaggctggagcgcagtggtgcaatctcagctcactgcaacctctgcctcccatgttcaagcttttcgtgtgcctccgcctcccaaataactgggactagaggcatgcaccaccaggcccagctgatttttgtatttttagtagagatggggtttgaccatgttgcccaggctggtctcaaacttctgacctcaagcgatccacccgcctcagcctcccaaagtgctgggatttacaggcgtgacccaccaggcccaagcaaggacatttttttctgagccatgttatttaaacagagatctgaatgacaagaaggggccagctctgtgatgtaggggaagaaaaatatgttccttctacccttctaggctgcccagctggagtcctacaaagttagagtgacaaaagacagattaacaagaggaaaagcctagaagtttattaaaatattcagtgcacatacacctggtagaaactcagtgatgagtaactcaaaggggtggttagaatgttgggtttatatagcatctgaacaaagaacagtaaacttgtagagaaatgacaaaacaaagaaaaaaggggtttaggtatttagggttgccaaactgtaggaaggtaaatatatgggagaaacatggagtatagtttgtttatgccaagtctatcttgagatcaacttttcgtattcttcatggccataacaatttcccaggagagagggcttatagcagttatcatttctcagaagtttctgcttttatttagacaagggaagcactgggaaggcttctttttgcttatattgattcttacttgcctctaactaaaagtaatctttatgtcaaagtgccatattttggagtggtatatattgatctcctataataacaatcaaaaggaacagtattctaggcaggagtaccactaatgcatagtgtttggtgtaaagacaagttaacatattcatggggcaacaacaacaataagccaatatggctaagacattgaggatgagtgagttggagaagtaggcaatggccagctcatataaagacttgttcgtttttataaattgtttagattttattgtaattatggtggcaagtgattggagagtattagcttcactttgactggcttatcgaaaacggaatgtagggggtgaaagtggaataaaaagaccagtcattaattgagtagtccgtgtgagagatgatagtggcttggacaaggacgattgtactggagagattgaagcgactgatttcagatttgtagtcaacaaggcttaattggtaggagaaaaaaataaatcagtgttaactctttaatgtttaacttgaataattatgatgagggtattaccatttattgagatgtagaatattataaagtaagagcagatttgttcaaaaagtatcaagaatctttatttggacatgctagtttggggatgcttattagagaccctaggaaactgaatataaatgtggattttagagaagagcttagggctggcagatgcacattaaggatctgtctagagccatggcgctagagacctccaggagaacataaatagtctcaagatcaagccctgagacactcagatgtttagaagtggaacagaagagggacatccaatatagaataccaagaattaggaggggaatcaagagagtgtggcaatatgaaagatacaaaaagagtgttgaagggagggagtaattaataaccagcatgttatgaggggctcagtataatgaaaagataagtgactattggatttggcaacatataattttttggtgatctggacaagagcaatttgaacagaatgatggatatggaaggtccagaggagtaggctgagtaaataatataaggtgggaaaatagatacaaagattatagacaactttttcaagaagttttactgtgaaggggcacagcaagctgagacagtgaggataaataatagactcaaggatggtaactttagaataagaaatttcaatctgatgggatttaagtgttagcaaggaagctttaagaagttattttccccattagaatgatctgaaaaatgttttagaacattcctcttatattctattttatcacatttatataactttcagagaattgaaagaggtattaagttattatgaaattttctgagattaataagataacaattataggatgttttcttttagttgaaatacacctactcagcctaatttttataacttcttactgaagtataatatacttcagtagaaaagcatgcctaatataaaggtgcagctagatgaatttgcacaaactgaacacatccctttaaccagcacttagattaaaaacagaaccttgatgatacctcagaggcccccttctgccccttttcagtctctccgtgctacccccatggataagcattatcgtgatttctaataccatagattaattttgccagtttttgaattttatgcaaatggatctatttcacctaattgtaaatatataacattgtcatagcaaggcactcattgccttacactgaaaattacattgactctttgccacaagcttagacttgctttctcattttattatcatcaagcctatagctttcacactataccttgttcctgctcttccctactctatttcttggtagatattctatatcagtcttagagtgcagtttgcagaacccctccatcagaatctcctagggagcttgttaataatgcagattcctaggcccctcccatggtttatgaatctgagagtgaggcagacaagactataccctctcatgcctctataatgtaataatgtcttcctagaatgttctttgctgcatctcttattaaagaaatcttatgggccgggcagggtggctcacgcctgtaatcccagcactttgggagcctgaggcgggcggatcacatggtcaagagatcgagaccatcctggctaacacggtgaaaccccatctctactaaaaatataaaaaattagccgggcgtgctggcaggcgcctgtagtcccagctactcgggaggctgaggcaggaaaatggtgtgaacccgggaggtggagcttgcagtgagctgagatcacgacactccactccagcctgggtgacagagcgagactctgtctcaaaaaaaaaaaaaagaaagaaagaaaaaaagaagtcttatgtttcctttatggccagagcacaacattgtcatgaagtcatctaaaatttcccactagaggtaacatctccttcccctgtctagctcttttaaagcattacctccatttgccttgtatcatagctgcttgtacacctgtctgtctttccgctgaggttataatcctctggagggtcatgactttgcattcctttgtgtctcccattagcagccagcacagtgccttgcatactgttagttctaaataacttctctctctctctctctctctttttttttttttttttttttttttttttttttttgagacagagtctcgttctgtcacccaggctggagtgcagtgcaatggcatggtcacagctcactgcaacctccccatcgtgggctcaaatgattctcctgcctctgtcttccagtagctgggattataagtgtctgccaccacgcctggctaatttttgtatctttagtggagacggggtttcaccatgttgcccaggctggtctcgaactcctggtctcaagcagtctgccctactcggcctcccaaagtgctgagattacaggcgtcagctgctgcgcgcatccctaaataaacttttttttttttggcatgaaatctgtaacactggaaagatgttattgccttagaataattaagagattaaatgtagaatctcaaaaacattcatttttttccatgaaaactttaccaggcctcaagggataggaaaattatgggtacagaattgagaatctgtaggaacttgcaagataaacaacggtttcacaagaaagaccttgttggagagttaaattttcagacagttgtaataacttcacattaaagttttgtcaaaaaataagtatctgcatgttttgtttgccttccaatgccctcattttatttgattttttcccataagtaactatagtgaaagcacgaaaatgtgtttctgtgtttgtgtgcctgtatgttaattgtgactgtttctattgcattgttattgcagaacctaggcacgcactctgtaggcttgggtgctttctccaactgaaaaaaatcctacatatggataaattatttttacagccagtgtttaattttacaagtggtccccctccttctgtttttaggatggcagagagaatacatatttacttaccattatcacttactcatgctttgagcttgaaggaaatgagacagaaaaatgaagtaacattaacttctctctggaactatgtttctcatattagagctttatctgaggagttcacttcctctctcttcaatgctttgttcctctccagtcgattcaaatgtcctcttaaagcagaagttccgaacctctttctgtgacttcaggagagcatgagaatgtaaatataagttttaggactaaattttcaaagactttttccactcagctctcttttcctcttcggtttgttgttgtcgttgttgttgttgtcgttgttgttgttgctgctgctgctgctgtttttccccttccacttccgtaactgagctcttagggtccatctggaatctgattgcaattaaaaaaaaaaaagtttatttttacctccttgtacgtgctttctcctaaagcaggagtcagaagccttttttctttgaagggctagttagtaaatattttaggcttgtcgtctttgtcgcaattactcaactacgctgttgtagtatgaaagcagacaatacatacctgaatgagcatggttttgttcctagcaaactttacgcacagagaaatttggatatcgtataatttttatgtgttgcaaagttgtattattcttttgatttctccccaaccatttaatatgtaaatcccattcttagcttgtgtgccatacgcacacaggcagcaaatgcgagttgtcacacaggctatagtttctgactttatgtcttaaagtaaacagtaataatcattctctttttccaaacagtccactaatctccctttgtattcagcccttgcatagtaaacgccgtttcttcatcatcctgatttttattctgagaaaatactgtatattgttcccatgcactagggttcggggaaatttaaaaggatgtaggatctccttttcattggtcctaaaattgcactggggaggcaggtcatgtttatgaacagataaatagtatcataatataatcatgcatttctatggctagcatttagaactatagcttttgatgtcatgtggtttttatatggttgattatttttttcttatttataaaatgaaaaagtttgagaatttttcatctccttaatgtattcccttatttgagggaaaagtatttacctactacataggaatttatcttaaaattttctttgtctatctatttttatggaatataatcgagcaactattttactaattaatactttaatatcattatgaaaatgttctcatatttttaaccttataagatcagataattgctatgccaatctatggttgaaatgggttcttatacttaacgctatgctctttcttctgagatgtaaaaatatgtttaaatcagaatttatataggtgtcaattcaaaatgacagtagttcattattttgattagtataaatgttcacaactaattctattctcttatctattaagtcaccaaataaagtatatttgttttaaatatttaacagtttaaattattctttgaaaacttatgagtctaaagtaagaacaattaacccattcattttgcaagtgggatagttgaattttacttgcaatccagggatttttgacagtttgaaatatacatacataccatgtatgtttaggaaaacatttaaaaagagggggttgtaaaataataatagttcttccatgattttttagccataatgtttataatataaaatatgtatactcttgttattgaatgtagtatgtttctaatttaccagaaggcaagagaataatcctggagaatttctcaaggcatcttcgaactctttgatttattgctcacatatagtaatttgccaaatgacgccctagtgaactgaaagaattaatgccccgtcctaagtcactttcaccgagggactgaaaacctgcagcattttgccaattagaggaggaaacaatctaccttgcagagtcaggagtactggataaaggagctaagagtgttgctttttttccccttcttactttaaaaatcccaattcatcccatgtctttcttaaaggctaagtgaagtagtaagtacgtttttgcaacatacgaatttagcagactggccttgtgtttatttttggccggaaccattacacttatttccaaccctctcctttatttgttggttgataatgggctaattttgaatctttactgtcaaaagaacattaagagaagcagccctgcctgcatcgcaggctatgtctgtcctttgccgagtattaaacactaaaaaaaaattaagaaaatactaacaaaatgacaaagcattaagaaaataaaactagatgttaaaggaaatgagaaaataggaaaggatgctgtacctggagtgattttttttccccaggctacctaagatgatcaaaaaagagctaatttctcttaggtttctattaaggaattactagaatatcgggcacaccaggaaactttatcagtggacctgtcctgaaccaaattttcttaatgtatatatgataatttgttaccacatcccagattattttacaggaattaaaatatatttgaaacactgacagggaaaattgggtaagacattgatagatactacaatctgtacttgaaactgcactcaaggaattcgttagtcaagaaagaacacaatgactgtgggcccctctgggttttggaacctcttttgtaaagcatttttttttttcccaaatagaagatattatttttgaaaaggttaaataaaaaatctttgttcactatatagtttcctcctaaggagtaaattaatttatataaaatattgcaatataaataacaattttaaaatctcaaaagagcagtgttttaaaaataatgtagaaacattaagaaatgacttcaaatgataagaatgtcattggagagcaaagggtttttaatattacatatcgtggcacgtatatcagcacccaaccgctcaagatacagagttctttacaaaaatcaaacagaaggaaatgtgccaccttgttcataaactatatttaataataagccaggcagataaagtcactttcacaaataatgagcaagcccatggtaatataattcatttacaataagatttatctcatggaattcttagactgtgctttgaaatttaaataattctgataaatgccaacagaatagagaaatcaattccagagcaattactaacacgttgcattacctttctaacattaatatttctcttcatacatatcattgaagagaaaatgaggatggaaaataaaaagatcaggtaatatatttgctttctcatctagggttgttatgatcttcaagatgaagttttattttttactcctagcaaatgatattcttttttattttagtttttattattttatttttctgtaaattattggggtacaggtggtatttggttacatgagtaagttcttttttttgatatttctgagattttttttttattctactttaagttttagggtacatgtgcacaacgtgcaggtttgttacgtatgtatacatgtgccatgttggtgtgctgcacccattaactcgtcatttagcattaggtatatctcctaatgctatccctcccccctccccccaccccacaacaggccccggtgtgtgatgttccccttcctgtgtccatgtgttctcattgttcaattcccacctatgagcgagaacatgcggtgtttggttttttgtccttgcgatagtttgctgagaaaaccacgaggtaccatctcacgccagttagaatggcgatcattaaaaatcaggaaacaacaggtgctggtgaggatgtggagaaacaggaacacttttacactgttggtgggactgtaaactagttcaaccattgtggaagtcagtgtggcgattcctcaggcatctagaactagaattaccatttgacccagccatcccattactgggtatatacccaaaggattataaatcatgctgctgtaaagacacatgcacatgtatgtttattgcggcactattcacaatagcaaagacttggaaccaacccaaatgtccgacaatgatagactggattaagaaaatgtggcacatatacaccatggaatactgtgcagccataaaaaaggatgagttcacgtcctttgtagggacatggatgaagctggaaaccatcattctcagcaaactattgcaatgagtaagttctttagtggtaatttgtgagatcctggtgcacccatcacacgagtagtatacactgcaccatatatgttatcttttgtccctcggcaccccttttctaccccccaagtctccaaagcccattgtatcattcttatgcctttgcatcctcatagcttagctcccacgtatcagtgagaacatatgctgtttggttttccattcctgagttacttcacttacaatgatagtctccaatcgcatccaggtcattgcaaatgctgttaattcattcctttttatggctgagtagtattcatatatatatatatagacacacgtacatacatatgtatatataccgcagtttctttatctacttgtcgattgatgggcatttgggttgatacttgcacacacatgtttatagcagcataattcacaattgcaagtgatattctcaggaagcatgatgtaagtgacagagacttactttgtagactgcactcattcacttgttctctgaatgtgctctaggcagcctgagtttctactatgtcagtgttacatagatgagaaaccccatgggtggtttccacagaggctgcaatactatttttgataccaaaaatctgtttggttttgtgagccccagatgcccatatggaaaactgaagtgttgatacctctttgtagccctctgatgaactgcatggttcaccttcctcagcagtttgagcggggtggggagagcgcctgcttcctagccatccgattggcctgaatcatcaaaaatgctatcatgaaacaggttctgtttatctgctccagattacacccatcatgttctagagtgctggtttcatgcttgaatctagatcaagcctgctttcctcccctgcctgtactccctgtggctacctacagtcctgctgctgacagataatctaaaccaatagcacctaattagcctatttgctcatgtgttttttccatcgtggtataatgtcctccttgtcaatttagggtgaaaatgtagcaacacgttgctgatggtttaatttctggaatgcaggtaatgaatgtgtttttgcttatccaagtcttcccatcagatgtcaaatatagaagaacagtgttcagaggtcctaaatttaaattggagtgagaaattcacagcgcccctgaactcaggcaaaatgcactctgacaagtcaaccagatattcacagatggtctggaggatttgaagcctaatttggtgaaataaaattaaatgagtgaaattgtatgcagtcattaatctatcaccatacttaaaatgcttcattgaaatttcttttactgcttcaaatgaaaaaagatcaaactatgttatagaaaagcattcaaaacccttacataacatagataaaacttggttggagacttacagaactttctctgctgcttcgagaaagttacagtgcccacaaatctattgctattagaatattttattgtattcaacactcaattctaccataattatgtatatgagaaaaatatttttacctataaaataattattattaccttttaaaaatctgacattcttccttttttctaaagaaacatatttagatttagcttttattttatttttgtgttgatacatagagattgtacatatttctaagattctagtgatattttgatacaagcgtataatgtgtaatgatcaaatcagggtaattgggatatccaccatctgaaacacttatcatttcttcttttcaatgccatcataccaaaaggaagtaaatagaatttcaaatataaggacagccatgattttacatacatgcctacgattccaccacaaaccataattacgtcccccaaacttttaacatttcagatactttgtcccaggtatttcatgataaggattgggctatgactctgttacagaagggccaaatgactaaaatgtctctgaacaatattgattgcaaatattctacccagttgtcaggtcaatatgttccaattcggaatttataacattgtatctctactcccaaaccatccaatctcacctacctcacttccatattatggtgggtgatctcagattatatttaagctcatggttacttgtcaagtagatatggagtttagcctaacttttgaaatttatgctgagattacccttctcattatagaattaagtaggcagtttccaagtttagatttagcaggcagtttttttcaaatcacttaaaagttatatttttttagggcattgaacaggtttgaaatcctaccaagatgtcatgtacacatagaccaatagaacagaatagagaacacataaataaaactgcacagctacagccaactgttcgtcgacaaagtcaacaaaaaaataagcattgggaaatggattaaagatttaaatgtaagacttcaagctataagaatcctagaataaaatctgggaaataccattctggacattggcttgggaaagaatttttgactaagtccttaaaagcaattgcaaaaaaaaaaaaaaaaaaaaaatgacaagcaaggacttactaaaataaagagcttctgcatggcaaaataaatgatcaacagagtaaacagacaaacaccaaatgggagaaaacttttgcaagttatgcatctgacggtggtgtaatatccagaatctatgaggaacctaaacaattgaacaaacaaaaatcataaaacatcatttaaaaaatgggcaaaagacatgaacagacatttctcaaaagaagatatacacgcagccaataaacatgaaaaatgcgtcacatcactcatcatcagagaaatgcaaatcaaaaccgcaaggagataccatctcacacccgtcagactggctttgttaaaaagtcaaaagacacccaatgctggcaaggccgcagagacaaggggatgcttatacactgttgttgggaatgttaattagttcagccactgtagaaagcagtttggacatttctcaaagaacttaaaatagaactatcatttgacccatcaatcccattactgagtagatatccaaaagaaaacaaatggttctaccaaaaagacacatgcactcacatgtttgtcacagcactatgcacaatagcaaagtaatgggatcaacataggtgtccgtcaacgttggattggataaagtaaatgttgtacacatacaccataaaatactatacagccacgaaaagaagaaaatcatatcctttgcagcaacatagatgcagctagaggccattatcctaagcaaattaacataagaacagaaaaccaaatactatatgtactcagttatgagttggagctaaatgttaggtacttatagaattgaagatggcaacagtagaaactagggactaatagaaggggaaaggaaagggggagacaagggttgaaaagctgcctattgtgtactatgcttactacctggttaatgggatcatttgtatcccaaacctcagcatcacgccatatatccaggtaacaaacctgaacatgtaccctctggatcttaaaagttgaaaaaaaaagatgtcatataaatattcgtggtcactaaaagtatctaatgtattatacataaaaataaaaattgggtgaattggaagtgtattctttgtatcaagtcatgtcggagatcctattctgctttgatcacagtgtgaattcttttgcatttttgttaccagtcacttctttatttattgaactaataattacatattctgataatctgtcagaaagataaaaacattctttgtccatgtgtctgaaaatttttaacctatttttctaatgttttaagtgagaagagcatgttaatactgaaattgtaagcagtagactgaaaaatcatcccaatccatgggttatatattgaattgcttttaactgtattactaaatattaagcttaatttattttatttctacatatccccatttccactataggtgatttgtatgaatttaggaacttccttctctcatccatttttatattaaaactcagactttctaaaacaatatttctatccatccatcgttggtaactatgtactgacatgttttgtgcatccgaaaaatgttagcattagtttgtgcgcacagaagtaattccagtcaccatatgatgagctgatttatttatttcgtaagtgtgttcattattattatctcttcagcacccaaatatataggggacttaatgatacctacaagtaaaaacggaagacaaaaacgccctgctctctacagaggttaaaatgtttttgcaacagggctctagatctcagctgtgaaagtagggacgagatgaggctaggcatgcagtgtcagtataatacaatataatcaacatgtcagcatctaatgcaggtgttgcaaaacaaaatgtacacatgggtagtcaggtaacagaaaagcatgaagtagtaagggctatctatgcaagaggttccaagctgactatatactgaaatatttaaacactatgtggggcaaataaaatggacattagaacagttcgatggtcagttggggacttctgctctttcttccagtctctgaacatatcttaaagccacaatcatctatttttatttattgttatacatttatttataagccagcacccctgtgatttaagttctgttgaaatgctgagttggaaaagatcgatggatgggggaaatttagtgcagaggttttgccccaggttcaaaatcctttataaaatattaatacatggaacaaatattgaacaattaaaccactgataagttaatcaatctgattcaaagtacacctgtgaagagggacatggcaagaaaaatattacagtaagaactagaaacattccttcatggctgcttgatatggatatgtcatgtttaagaaaattcttctttagactgttgagattttttttcctgacaaagaagattcactgtcgaggaaagaaagaggtactgtgaaatttgttattgaaaacatgcacatacttttgtcagaatgagttaaagagtgaacaaaatgtgcctattacttacgtgttgtgctgttttaattcaagattaaaatatttaacgtccacagacaagaccacttttatatgaatattatttttctgctttattgctcaattttattaccatttcaaaacacccgtgttgctttctatggccaaagatgtttagcacttttcatggttatacttctgtacagtccaaaatacaacacttactttacacatacacaaacatccaatgtattttgttttctgtcaagtaaagacaatgtctgtgttattaagttaaatgtcactttcaaatacaggatatgttgatattagaatgttcaactttatttcctcatttaagcaaattacagtgtgaagaatgtaactgcagcaatttataaaaatcatatcacattcaattatgagagcaaacttgttttgtagacttgaactagtttcaattaatcttggagttatcatttcaaaaattctaaacagagagaaatacggagtgtaataatggtaggtctttgggtaagctgcttccaggaaaagaaagcaattatatatgttcacatagcactgacaaggagaaacaaaactttggacggcaaagaacttgcattagtctttttgacatgttcctgtggtgtgatttattacgtagacaatcagctcaacttctcaagtttgatatccttggaatcatttgaaatttaaattttaatgaaaattcattaattccaaggccaaaagaagtgattctaattgcttttgagaatcagactatgaaagaattctttggcaaacttgcactgtcttttctcttttatcattggttgcttcgtaggtacttaattgaaggtcctctgattatcagcacgggctgacatcagttcactccatgcattttaaacagtaggccagatgtttaaaggatcagctgaagcatcgatagcatgctagggtgaataataaaattttcattatctacaagaagcaaataaaaagcataagcattttcccccattatcctgaaggagaagatgaatgcctaagcaacattttaagaatgggttgagtgtggcctgtgggaaaatttgggtagaaaacttgtagttagctaatgtatatactgtttgcctctttagctcaccatatacccacacacatgggcatgcatgcatacagacagacacatacaatacacacaacaaacaggaaattcagatatactgaagaaatgtatttaagggattactaagtttttgtaaataaaatcctttaagatgctgagaaacaatggaagagaagtaggacatgatggctcatactttcgtaatttacttgtttaacgtttgccaaggtttaaattaatgtagatgtttttgtggctaggattaatgatctaacagtttggaataattaggcacttttatcacctagaaagcccagaaacccagcatgcaaaaattctggtatgtctgcattttacacttagatataacagagaaatgacaagtagtcaagtggatagagaaacgaatgattcttcacacatgcacacacacatagaaattgtctttttaatagtattttaatgtaacacatttatgcataatttctccatagtgtttatcttatagtgaatatgtgatgaatagtctctaacattagtggttttatagattaaacataattaaggctttatatattaaagagtcaattggtgacattctaatataaacatgtttatctcatatacattgaaatattagataattcattcgttgagaataaatcgaatgagtcaaaacttttaacctccactttgagctttgtaatagtatccactgaaaatattcatgaaaatttttaagtcatttctatttatatattcagtccaaacatctcacaagtttaaaatgtaaactcaagaatataatttctgtattctacaattggaagcatccatcatatcagatgaacttatatagtttgtgaaattttgcaaactttctgtttagtaaatcttaatgtcaaacattttaacttccaggttgtctttcttttcagttttaatatccgcgatctttgtatactcgttgaatggattctcaataagtaacccacaaatatatatacatactatgtacctacaaaaaataataaaaagtaaagaaatcgacacttatccatacctgtcccatagtaataaactattcataagtatatttgaaagatatgagaatcataaaagttcgtgtttgcacccttttgtgcgtggaatcctaggtttgcattttgtggatctagactttttggagtgtggaaataaatgaaacaaataatcgagacccagtcttatattcaggttatcattttactacataaagcataaataacatttgcagtttgtttctatggctagctctaaagtcttagcaacgagaacattatagaaagacttcaactgtagcttccagcagaacttctgaggttccgtttatggactaagcagcagttgagggggacaaaactcataggcaattgatcactccaaaggatagattgtcttttctaacctaatcaaaagatttatagtgaaggcatattcagattttgttgaaggatatggatatataatcatgtgtgtgtgtgtgtgtgtgtgtgtgttagacatacttaaaacattatttgagtagaaaattctgcacaaatggaaaagtataacatgtgttatatccacacatgttgagcatttacctggctgaaacatcaaaagctgaattgacttaattgaatgttgaatacttaatagttactttgtagtgactcactattaaaacattatctcaagctttgtcagaattaatttttttaaaaaactcagattagtgtcaggtttactgaaacagcagatctgaaattactgtgtttttttttcctttcaataatcagtttctaatccaaaattgaatatcagttccaactctacattcagtttctgttttacttgtttggactggcttttggttctgttttccacatagatcctctctgtgtaagacaaagccatttgtgcagattaaattttactgagcgtgttaacctatttaaaacattcatccaaaaagactagtatgaattcttcatatggcaagctgcttgttttaaaacttccatttattctaaaatcctttttacttatactttttaagaaacgtattcccgatatacaaaagtaacacatgctcattaaaacaaattaaaaatagtattgtataaagagctgatacatttctgccttgccccatttaactttcttaagtgttcatgtgaatcatccattcacatcaagacatttatctgtattcatatgaacgtgttttaatatatataacatatatagaattttatataaactttccttttaaaatagaaatgaaattatatgatatatttattctgtgtctagctcttgtcacgtaattattcaagaacatatttctaggttaatatctgtattcttaggtagcattcactaactcctcatctacttgttttcttccattctaattgtgtttaacatttcttcatacaattggttgtcatttggtcttctttcatggagggtgcataatgttcattctcaccaattctttacactttacataactgcttgatacgaagccagaccttataaatatcaacaaagcaggaacactgtaatcagctatcagtttcagttgagctgaatgaccctgaatatgtgtacacatattttccaggagattttaaaactgacacctcagatttctaagacctggagaaatcagcatgagaaacattgatctatattattccgtgaaatgatttcactaaatagtgaagcatctcccacatgtggactctgtaatttattagaataaagagttcatgtgcttctgaagaacttgaactactcttctggcctccgtacattggtttcttagctataggaaggctgagcatgtttttcctatgcgtttcctttctagctcatcattttagtgacaaaacaatctttcgtggtgttgctctagctatagaattgtttcagattcatttgaccaaaggtggcaaatacaacagtcccaacaaaaacaaaagacctattacagaatgatggaaatgaccccagggaacaatggcacctccacatttcttaattccaaggttataagcagtggtgtggacaattctcaattccaatgctgaatcgccttctaatttcaaatacctgtgctaaaaattatttacgtctactgaaataatgaactggaccccaccaggaatggccgatatgcttgtagtcagagcacaactgtagaaagaaaataacattttaatttatagaggtatgatgatagctgtttcatactgttttcagaacgatgaatggcctgctcagtagtttcttgtcatcgtactgagacactttaatttcttaccagctgagatgaggaatacgagcccagtgtgcaggtgaaattggttaacaggagccattaaaatttggaagagtcagaatagcatcaatcaaaatgctttcagtgtaggaagtaaacatgtactagcctgacccacctgtcttttcttttaggtatgttggtaatattacaatcattttgaggtatccataaacaactgcttagatctgaagaattgtatatctttctttactctgccctggcctggggttatggttctcattgagctctaacctttcagaaaaaaaatgtagagaagtggttcaagaagaatgctttatcttgcttcataaaaatgatagtgatagttttattgaaggcttactatgtgccaggccaaagtgcgttttattatcgttcccattttccaggcaaagaagctggagcacagagaggctaagtgagttgtccaggatggctcagctaacatgctgcagttgggatttgcacccagaccaacttcttttcaaccactgtcccatcctgtgtcttctctactcaaaaagtgtttcagctccaaacctgaaactttaaagaaaaggaaatccttagtggaaagactaggttttagtcacaaattatctccttccttacattatttgtctctttttcaaatactccaagctttgattaaaactgtctatcactaggaacattgtagaattgctaaggtggaattgttaaaagaactcaattccaattaactttgccattgattactgtgtgttctggaggggtgttctttctttcaggttaatgatgctttattgtatatctcaaagattaaaaataacaatgaaggaagtagcaaaccggaacttctctcacaatgcatctttcaatctcgtgctttaaatgaagataaaatcatggctgtggtaaggttgcaggaaggatgatatagattaagtttcttgcaaactgccctctgaattttcaatagctgtagaaggtattggttttccaaaaaattgacaaattgaggattcattcagcagtttttttctaggtctcttaccagaaagtgatcactaaaaagtgtagggaaaccactcaaagttggatagatcattattttcacttaagcattttaatttcttgaaggagctttataatgcaacaaagaatttacagtcctgtgtcaccgcttaaattttctagggtcatcagtaaactcagtggaaataaattagttcatgaatataattgacccttaaattctgtcactgtgcaagtaatcggtgggtctgctggatatggctttcgagcagacaggtcaacttcttcaaacagagaagaagcatagcataaattgaagacaaataacaaactacttgtttcctccttctttggcatcaccctatggatggagtatgcatttataatttaacacaatcaagagatctttattatcctacttttgggtacaactgcttcgtttctcttttgaatctctacagctatttaaaaatctgttttgtaaaattctttaaaaaactaaaacatcagattcatatttcaggtatcttactatcttataccaacttaagcatccagtattatcacccacccttcccctgagtgaatccttagcactgggctcttcctgttttatccctgtgcatgctgagctctttctggccttcaagtctacttccgttgcaactgttgtctgaatggtctctctatgtccttcttactctctaaatatttcggaatttaaagcctggaataatctaccttagtccaaaagatatgctacactattctagttcacaatgatctcacactgccgttgatacacaacatttaatatcaacttaatatctatttcagttcattacgaggtcacttatgctacatcttatattgttgccttggacttttattatctcttcatatatgtgtttatggtgctcccaccctcacgagaagttgcaaataccatgttagctgtctgatggctttctatgttgtcaggtataccatttcccaaccagttggcattcaatgattaagttcattaacaaagaattgtatgtgttgaaaaagatgtttttttcttaatgaagcacttgtttttatttttttaatgaaatccaccctcttaataaattttaagtgcacaatacagtattgttaaatataagcaaaatgttgcatagcagatctttataatttttttaaccctacatgcctgatagtctatacccattgcacagcatctcaccatttcttccctcctccagcccttagcaaccaccattgtactttctgtttctataattttgactactttagatacctcatgtaagtggatgcgtgcagtatttgtccttttacgacttgcttattttatttagcaaaatggctacaagattcatccacattgtagcatatggtaagatttcctttttgtggcagaatgatattccattgtatgtatataacatagctttatacattcccctgtcaatagacatttagtttgttcacacctcttggctactgtaaaaatgctacaataaacatgggaatgcagatatctcttcaagatcctaaattgaattcgtttagataaatatccagatgcgggattgctagatcttatggtagttatattttttatttttttgaggaaactccatattgttttccacaaaagctgcacaattttatatttccaccagcagtctacatctccaattttcctacaccttcaccaacacatgtaatgatcttgggctttttttttttttttttttaataatggttatcctaatccgtgaggtagtatatcattgtggatttgatttgcatttccctggtagttagtgatgttgaacatcttttcatataactgttggtcattttaatgtcttctttggagaaatatctattcaattcctttgttcactttaaaaattgggttgttcgaatttttgttgttgttgttattacgttcctcatgtattttagatattgacaccttatcagatatatggtttgcaaaccttttctctcattctataggttgcttttaattctgttgattgtttcccttgctttgtagaagctttttagtttgatatatttctgcttatctagttttgtttttgttggctgtccttttagcgtcatatccaaaaaaaattattgtgaagaccaatgtcaggaaatttttcccttatgttttcttctatgagtttcatagtttcagatcttatttttaagtctttactccatttcattttgagttgatttttatgtatagtttaagttaaaggtccaattccattctttgcaatgtgtatatccagttttcccagcaccattggttgaagaggatatcctttcccagttgtgtattcttggcacccctattgaaggtgatgctaggtttatttctgggatctctattctgttccattggtctatatgtctgcctttatgacactatcgtgcgctcttgactgaggtagctttggtaattcattttgaaactagcaagtgtgatgcctccagtttattcttcttcctcaagactgttttggctatttggagtcgtttgtggtttcatatgaattttaggaaatttaccttatttctgtaaaaaatgcgattgggattatgataggaattacactgtatctgtagatggtttggatatatagacttttaaatgacacatcagatgtatttccatttatttttgtcatcttcaatttctttcaacaatatttcatagctttcagcacacacatcttttaccttcttggttgggtatttactaagttatttattctttttattgctattgtaaatgagattgttttctaaatttcctgtttttatgttgctagcgtatagaaacgcaactgttgaatgatgactttgtatcctgcaactttgctgaatttgtttattggttctaaccatgtctctgtgtggcgtcactcttaagattttctacgtatcagatcatctaatttgcaaacagatataattttacatcttcctttccaaatttgatgtattttatttctctttcttatctaattgttctggctagtacttctggtacgattttgaaaagaagtggcaaaagtgtgcattcttgtcttgtttctgatcttaagggaaaagattttcagtcttttgccattaaatgtgatattcactgtgggtttttcatatacggtttttattatgttgcggtaatttcgttctattcctagtttgttgtgtgtttttatcatgaaagtgttgaaacttgttaagcgctttttctgcagctattgagatgaccatagatttttagcctttgttctgttaatgttgtgtatcacactgattagttttcataaattgaaccatttttgcattccaagaataaatcctatatggctctcgtgtataatcctttcaatatactgttgagttcagtttgctagtattttaatgagttattttgcttctatatttatcagcggtattgttctgtacttttctcctagtgtcttttattgactttgatatcaggatactgatgccccttgtagaatgagcttggaagtgttctcttctctttaatttttctgaagaatttgagaaggattggtgttaattcttctttaactgttcattagatttcaccagtgatgacatttggtcctgggcttttctttgttggaaggttttggactactgattcaatctccttactagtttcggcctactcagattttctatttcttcaagattcaatattggtagattgcatgtttcaaggaatttgttcatttttttctaggttaacatacagttgtttacagcagtgtcttataatcatttgcattctttttggataccagttgtaatgtctcctctttcatttctgattttacttatttgaattttcctttttttttttttttttttacttaatctacctaaagatttgtcaattttattgatttgtttttaaaaaaactcttagctttgttgatttttctattgttttctatttcaattttggcttttttctgatctaatcttaatatttccttccctctgctaactttgggcttagtttgtccttctttttctaagtctttgaggaagaaaatggcaaggacatgactttctttagcagttggaaggacaatgctgtaaatactcaaaaattaattatttttatagtgacaaaaacaaaataaaaaacacttcaaagcaaatgaaagtttatcatttaatttatcaaatcactaagcagactgcttgatcagagagaagatactcatatgatcacataaaactgaaagattaagaggtaaggacattcatgttatcattacatctaactttcttatttccaagatggagaaactgagggttggagaaaaagaaagatttctttgttagatacaaacagacaggactaaactcagtatagcagcctcctaaattccaaagtatcatgatactgtgattttatgcattcttcagaaaaatagtagagccactggattctggcaaagaagttatataaaatgtcaagttcttcctttgcctcagaaatgaagttttatgttccaaaattgattgggaagttctccttatacctcacatcacgtctactattttacattgtttacttttgaagaatttttttaattgacaaataataattgtacatattcatggagaacctagtgatgtttttatatatgtaatgtatagtgatcagatcagggtaattagcatatccattatctcaaacattggtcatttatttgtgttgggaacattcaacgttctccttctagccatttgaaacttctatattattgctaactatagtcaccattcagtcgtatagagcactagaacttatttctcctatctagctataatttatttttaaatatgctttttgaatctgttactataaattgaatgtcacatcgttttgaaaatattcttaatttatgctcaacaggcaagattacacacctgtgataatatctttaatttaaaacattactctgtttaatttaccagaatatggaaccctagtcattttagaggtggagcaaatttcagtgataatctagtgcaaatttctcatcttatgaatgaggagattgagtctgatataagggacgagattttcgtcaatgagcagcttgttaacattagctctgtgatagaacacaggcacttgtcctcccaggccggtgtttcttctactctatgatgggctgttttgttgtagtttttaaacagcagcattttcaccatgcatagttttcttccaaagttcgttcttaacgtttttgcacagaataactagattttggaagtagaaaaaggaaattctctttgcatccttgtatctctggttattttctttgtcctttgatctctctctcctcccctcccctcccctcccctccccttcccttccctcccctctccttcccttcccttcccttccctcccctctctcacacattagagaaagagttaaggtattaaagaatacataatactattaaatttccttcacatagagaaaggaatgaaaaaaagtgaaaaatggtcctcaccaaatgtccaaacttctgtaggtcatttccatagtatcagcaatgtcctgtatggtgcctcggggatatgtaagcaaatgagcaagtggttagctaattctagctttggcaaacacttgttatggcttacttgaggagaagtcacttctccaaagtgaaaataatgtgcacaggtcaattagaatttttttgtagaaaaggaaaatactttgtagggacatggatgaatctggaaaccatcgttctcagcaaactattgcaaggacaaaaaaccaaacaccgcatgttctcactcataggtgggaattgaacaatgagaacacatggacacaggaaggggaacatcacacaccggggcctgttgtggggtggggggagggtggagggatagcattaggagatatacttaatgctaaatgaccagttaatgggtgcaggacaccaacatggcacatgtatacatatgtaacaaacctgcacgttgtgcacatgtaccctaaaacttaaagtataataaaaaaaaaaaagaagaaaatacctccttatgctcctgacttattttctttttggttcctcagtcctcttctctctctctctctctctctctctctctctctctctctctctctctcacacacacacacacacataccccacatatacaatatgattaaggatatatgtgaataatgaaagcttcttgtgtatagatttagaagtctaatggacaaaatcaatattttcctatgtgcatttaattcccccctttgatttaggtatatagtctttttttaaaaaagagaaaaaaaattaggtgaccttaaggtatagatcctactttcaaaaggtttacagaactagggagaggaacatggacaagatttaaagaactattttaagcagaataaaatgtgatttatgaacaaagcatatattatttgtgcgtatgtgtgtgtgccaacaaagatgcaattaggagattgcacagggagatgtcattagaaccaaccttaacgggtgagaagtctttgaagacatttagaacatggaagatctctgacagagggaacaaaggcatagtgacaaaagtcaagggcatatttaggactggagagtggtatgtgtggcttgagagtgggcgagaaaaaacaacaatgcctctgtaataggaaagtagacagaggcatgacattaagagctttgccagctgtgctaaaagtagtgaacaagagctaacaaagtgaagaaatgtaccttttctgatgtgtatcattcccttattcatatacttcttgagggggaaattcattctgtgttgatctagtaaactactacaggaccaaatgataaaaagaagtataggaaagaatgtttcagcatactttacgagataacttccttgtagctattctccatagtattttgagcatcacaaagcaatgagctgaaactgtctaagccaaaattgacttgtcatctgttagggatgcttagatgagaattctacatttgagagcttcttagattcattgaccactatgtcccattctaagatccatgaatgcgtgacctaactattacaccttcttttagtctgattgtcaattttgtattttcaattgtgcaagtttctaaaactattttaggaagataaatctagcagtggtgtgggaatagacaagagagaaggggaaagactcttcaggaaactaaactcacaatttatgagtattctttattgcccaagtcttcccaaagtctttcatcaagaaagaggcattgcaactctccttttatagtttgtttttattctggagcagtgatgttttggtggagttgttcctcagtgcgtaattaaagggcctatgacaattacagttcatctcctgctgctcaaggtactgcagatatttggatctactactctcattcatttccaattaatgtcagctttagatttccttcagtatgctatgttataaaatttgattatcgttgtgcccaccttcccacttaatttcaagcaggtttctcgattacctgactaaactaatgaaatctgactaacccaatatctgtggacagtagtgtgatgttactgatttttgtatgattagtcaagtcatattcatgccacgttttcatatagtaccataaaggatattcttctcgtggtccttttcttttattctgaacatacaatgagaagaccggtaaagtgggctaggaaattaaagaaaaatacaaatggcaaaaaatatgggtcactcgaagtctagaatagagagcacaatcaattttgaattaaggggtgataaggtgatttggtcaggtgactggtgaaacaggaaagaaactatactttttgaagtgtttcatccatgtgttaagattcatttggggtcaagaatctaaatttcatatccctgggagtggaaactaagtaaaaaaaaaaattatggaccttggtttaatagctagaggagcaagagtgtatctttatgtgacttaacttctatgtgaaaagtgaaccttaagattaattattgggggaatttacttactcaggttctatgcctagatggtctgcccaactaagaaaacttattttcctgttactccatcctatttttcatacttttatactgcacttgcagaaaagcatatatttctacccaatacgaaaattcctgggaacatatttttctacatttcccaaattacttcaaaaagtaaacttaggttatttcatgatctccattacaatggacaggtggccttattgaatgttgtcctgtgaatacaaagatccagagtttaaagaacaaggtgtacttgcatctcccacttagggtttgcttgtggtggagagagaatctagtttgcttaaaaggatgacagtgcagtgccccaaaatatctgatatcattaaaagtctcatatttgtctttcgtaacttctctagggctgtcgatgacaggagacccttaactcctatgccttgattatgtgaataagcacatgaaaatattttagttatcttagttcacttttaaactaagtttcaattatcactagattctaaatatcatcattgagccgttcttaaggaactgattttctacatattcattcacttcacctatatctagtgtgtctactatttgccaagaaaaatttactctcttaattcagcattccatatacttaacatcataaaaagtaggccatttttagttttctaaattatttatttaaacatttctttaaaattacattctatcattacactatatttcaacactacagtaagcagcctattttgtgatttttccttatataaaatacataattgaaattaaaaatgaagttaccaagagccattttcactctggggaatgcacatttataaattatggggttattttttcttcatcagctttcatattattaaactttgtctcttcataattacagagatgactagacacagaagggaatttaacatttggtgtgcatttgtctaacctatactttatgttagaaaatacatttccatttgaaaaaaaatcagtaattgtgggtgtgatcaagagggcagcctgaaagtcgggtgatgtgactcacacctgtaatcccagcatttttggaggccaaggtgggattatcgattgagcccaggagttcaaaaccagcctgggcaacacagtgagagcctgtctctattagggggaaaaaaaaaaaaagaggaagttagcctgaggcaatgtaaatgaaatacatatttcaaggatatttatacatgattcacgttattcatataaagatgtgccagagaagactataggtacgttattttacactattttgctaggattttaagaaattcaatgtgtttttatttcagttaacttagaaaacttacctaacttatacttctcatggacacaaaagtttttaaagataggatcaaaaagcccacatggtgaagcattttgaactggatgaaaaacatctattatctttaaaattttatgatattactgattgtaatagactccctttttaagaaatcattccttatagaacataaggtttacatttacaatcaacaatttctatccttactacaataaaggcacatataaaaagtacagttgcatatttagcaggtttaattgtacattttaatgtagaaatcaattcaattctttcatttatcagcattattacagtgatttcaaattaagcataggtaactttgatatagataaatgatgtacacagcagttaaattttattttcaattatgtagtaattgtataacctaggcagtataatttgtaaactttgtattttattattatgcttctcccacttggcataagcacaacacttcctaaaagcataattttctatagacttaataactccctaaaaacctgttttggacccctatactatttgatataggcagaaaaaaaacataatccatgctcaaatttgaaaaatgactggtcacatttggtataatactaaaggtaaataaaatcaagagtctatgaacatttccggacctgcacatttgttttattaaaatgcataattgtctttagtgtgtttctatttgtttatactctactgattttaattaaaaataccaaaatacgtttattaaaaaactgtcagaatctaagttgttaaatatacttaactaggaaagtaactgtttaaacgagataatttatagagaaatgtggtgtattgccaattagatgtcaagatacaatacaactgataatgaaaaagtagcattttcttagggatggaatacagtgtaaggaacaccccagtaagaatacaaaaattactgaaaaaaaatcttccttcctgaaaaaccaagtgcccttcaagtgcagaacctcatccaactaattgttaggtatcactaaagcctgataccttcaattttctggatcattcaagctgtatttttgagtccttatactagaggaggtaaagagctataaaaacacttaatggtatctgatgtgaactgtggatcactttgacccatcacttctacgtctacatcttggataaattcccattgttgtcatagattgtacaggtttaatggtgcgtttgtggagggggctcgcttatagaaaatggagactctgaagggataaggaataaatgtatcacttcaggtcttttatttgaaattggggtccagagagcctttttgtatcagacttgtcaaaccatttccatttagtaattatatatgcactagcacttattcctacttacctcacctctttatgcccatttccttgtagttgcggttatgcatgaataatttattgcaccccttaccaacaatggaataaaacttccattctgaaagctttccatactcatttccaatagcaatagggtttttttaacggacgtattacaaatgtacgagtcagttgaacatagtattcctctttgtaagaactccaagtggatgcatgctgttgtctcaaatctcaattagaccttgctttgaggtcccttcattgccagtcatctgttctccttcccctgacttgagtatttctccagatatagataatacattttcccaactctgtgttccaagaactgacagtggctttcattcattttgtttgtttgtttgtttcttctcgttctcaagtatcccgcagtctactgtttcttccctccattcgtttgtcctttcagagtttcaaaatccagcataggtacttcttctaaaatgtcttacccttcacatacacacaccacttgagaccccatcagcctctgtccacacagtttggttacattcatagactatttttatacatcaaaatatttgaaaattttagggtaaatctcagtagtcattcatttttgctcttattcaaccaatactagtcaatcagcctgtgccaggttttgttgcaggtaccaggtatccatccataaagaaaacaacgtccctttgttgtggaatttacattttagcaggggaggcaaagaacccaataaatatgataaaatatcagattaaaagtacgatgaaaaaaatcatcagggtaaaggaaaaagggaagcagtattttagcaagagtggtgaagagaggaggctgagagtgtgacatctgagcagagacctaaatcaagtcaaggaatgaaacatgctactatctaaagaaatgagtcaggataaggaactagtaagagccgaggcccagagatgtgaatatgctgttccaggaacagcaaagagactggttgatatgatgtgaaaaatgagaagaaaccttatgatatgtgtcaagagaaaaaaaaaatttaaaagcatgcttgggaacggaggcctccagatgaaaaaaaaaaacacagttcaaatccttgttcatgcatttagtttgctttgcaatcttgggcaaaatgttaaatttctgtacgttttatcttcctcatttttaaaataggcacaaggacatctacttaataggttcattgtgaggagtaaatgagatgatatatctaggatgcctggcattatatcatacacttaataatacactgaataaataatagttatgtctatttatttccttatcgtttttattattatttcaatgcacagacctgttcataagataatgataaatattagtggcagaaactgaagatgttataaattattaggaggcgggaccactcagttcaatgtatctgttttaatatagtcagcaaaagtgtgaagataccaacaattaaatttcaatgcattcttccatttcactagttttataaactgatgaactaccagaatgtcaatgtatgaattgcatactcattcttaacaaacagatttgcaaaattatgtgtaaaattagccctcagccttccaatttgttattgtcatatttcatggaaatacataatctgtaaatttttgttttaatgatatgtgaaactgcctaaagtagagtcttggcaactacttcacatttgtcctccagagatagtggataaaagtgtcaataaatgaacactctatattcactaatcacaggcaagggacaaggaacagagtggtcacaaaataccacaaaattaaagcacattccaaattaaatatatatgtttttattacagataatgtttgctagactctttctaattatctgcaaagattttaggaatgttttaatgttttaatatttacacacctgtgtatttcaagttcagtcaaacactattgttaaaactaaatcttctcatctctaataataagatgtgaacttatcttggaaggtggttattaggatgggagagataatgtatttcattcaaagtaaaaatatttctctgtttctatctttctctttctctgtcatctatttatcatctatatccaggtatctatgcacctatgtagactagcattcaatgaaccatagatattattagtagtagaattgttactaatattaaaataagaagtatttaagaagaaacatgtcctaaagcataaggtcaattattactctcatgttttttggcatatgaagcctaaaaagtgtcaatttcaagagagtattaataaagattgtgataactgaaaggttcctgcttgaaattttgtgtggtcttacaaatatataaactctaagcatttcagtgagccaattactgactaggcactatgtcttatgactcttttgtcatagtatgtaaaaaacaaagagtagagacatcataaaaattatagtagatgggcactagggaattacgcaaaataatttgtagatttaatgtgaaaccaaaacatctgttcaagtcaatttcccacaggtcatgtggcaaagagtatgagttccagactgaggagaggaaaaggttgttcttccacagggaaataaactgagtgtaataaacataatttttcttcttaagcattatttaaaacaaaaaaaatgccattaaatctatctttcctgcctctcttatcaatgctcccttccctttcaccacttgtttcaaactccaagccttgggattttattttggctttttgccttaatgtaactaaaatgagagcatcacaaatatgaagctcatcaaataatttagcagcattttcccctgtttttaactttctctttggaaacgtagatttcgaaatttaagggcccaaaatatgaaatgcaattataataggccatttgttcattcagcttgataaacttgaataaatagtattgaacttttaatgcaaaaagaacaaaacaaaatagaactctccacgaagaaacttttcaatgtttgcatttctgtgtgaggagaagggtaatgaatgtgggaaccttaatggaatccatgttcttccagtgatgacaagggtcaaaatggagaaaaatggtcactttctacccagtacattatattagttctatgtggacaactataacatagctgatgctggttttcaggccataaatgtaggtatgtattttcctactatttataaggcaaaatttctatttgtttaatgatttctatataggtagattattctgtctttaggattaaaaacgacctgtagaccaagagactttctaatgtccaccttagagtatatggcttttactgttacagtttccatttcctttgcttgcccctttgagagaaggaaaggagacatttgggatacatacatcaatgaggagctattaatgaataaatgaatgaaattgtcagtcaatttatccacatgatcatcaattgccaataattttatcacctctgtgggattaagtagaggtaacagtttagaaatttgattttttgaaagcatttaaaatgttcaaatatatcactctggtaactaagggaaagtgtattattttcttatgcttagtcttattttggttttgcctttttaatttaaattgaacacttatatcaaagagcttgcaggattataatttgaatttttgaagcaaagatcattttcttaacatcaaacaaagagtagatacaataggaataaaatcggcagaaaaacaagagtatcaaggacagacggggagggtgggtctgtgttagcatgtattgctatgaagaaatagccgagactgggtaatgtatttttaaaaagagctttaatcgattcatgattctgcaggttgtacaggaagcaggacaccagcatctactcagcttctggggaggcctccgggagcttttactcatagtggaagatgaaacaggagtaagcatgtcacatggccagagcagaagccagggggaggttgccacacatttaaaaaaaaaaaaaacaaaacagatcgctcaagaactcagctgctatcatgaggacagcatcaagctgtgagggatccacctccgtgactcaaacatctcacaccaggccccaagtccaacacttggcattatatttcaacaagaaaaaaagtttaattggctgatggttctgcaggctgtacaggaagtgtggcacaggcatttgcttggctcctggggaggcctcagggagtttttgctcatggcagaaggtgatgcccacacactttaaaaaaaaaccagatctcatgaaaactcactcactacactgaggacaatacaaaaccatgagggatctgtccccatgacccaaaaacctcccgccaggccccaccaccaacattgggaattatatttccacttgagatttgagtggcggcaaatatccaaactatatcagggctcatgtccagttatatgtcaacatgcctgcattcgaaacatcctgtccaaatcactgccttgtcataatacttatatttttctttattgaatacgaacacaagaagattaaataatagcatttctactttaaaacagtgggcaccatattaacattggaataatagtagtaataacgatagtaataacaatgatataggctgggtgcggaggctcacgcctgtaatcccagcactttgggaggccaaggcgggcggatcatgatgtcaggagatcgagaccatcctggctaacacagtgaaaccccgtctctactaaaaatacaaaaaaattagctgggcatggtggcaggcacctgtagtctcagctacttgggaggctgaggcaggagaatggcgtgaacctgggatgcagagcttgcagtgagccgagatcgtgccactgcactccaacctgggcgacagagcgagacttcatctcaaaaaaaaaattaaataaataaataaataaataataacgataaaaggatatgtgtaggttttttttttaataggctgttaacattaataggcattgtgatttcagggatatcatcaaacatcctggtcctaagacatcccctattgaataggaagggcttaagttaaacttctcatgagccacaattttctgattatatgtttggtgtgtgtaatagccacctcagtgatgatttgattagcctggacccttacataatcattgaagtatacccatgttcctttatatacttctttagtgttgaaagctcaaaattaagcaaaatagtccccttgataatgtttagattcttaacatttgctttctaaagctggcaaatactctcttcccagtgtcatgaagttaaataacatgttgcttagtgaggactttaatgttgccatgccataggaagaccttattcgaaatccccttacctgggagaatgtcagattattaccccccaacttgtttaacacttttaggattttaaaggtgttcacatttgtattagaacaaaatactattgagaaacatttctagaaaaaaattatctttccaaattaaaatcagtggtatgtaatgtaggagtctgattataatgattaaaatacatgggctttgggcatactgcctaggtgaaactcctggtttattgcatcactattagtataacctatgggagttaacctacgtaagcctcagttaatttttctctcaaattgatctaataatcgtctctcataggcttgttttgatagatatttcagtgtatataatatacttaggacagtgcctgatatcagtaagtctccttatatgctatttttctttctattttaattatttatgcaagagaaactattatgctttaactcaattaaaataaaatgcctttgtatttattcatgtcaaaggaaatatgcaagtattgcattcacttcctaggtgcctttttgaattgagctttgcatggttagtttgtataaaaggttcagtgaactttctcataatgattttttattgaacatatggaatccattaagtgttagcaaaagtcactatccactgagctgtgtccaggggctgacagttatgtctatctcttgcaaaaataaacacatacataaatgcactaagacgtatattacctgtcgtcatctcttagagcatttccatttttcttttaagttttttctttcaatgggttttttatctttgtgagtacatggtaggtgtatatgtcaacggggtacatgaggaaggtgtatatattgatggggtacaagagaggttttaacacaagcattcaatatgaaatagtcacatcatggagaatgggttatctatcccttcaagcatttgtgctttgtattacaaacattctaattatactctgttagttattttaaaatgtaccattaagttattactgactatagcaaccctattgtgctatgaaacagtagatcttattcttatttttctaacatcttagaacatttccacaaacactacctgcttgttaaatatacctattctaatcttcatataatcaattacttttttcctctagaatgtactatgacacatccatggggaaaatgtagtaatctaattaagactatttcctctcattttatatttaaaagaatgtgctctatcaatttatttacttgtacagccgtaggcaacctctaaaatatttaaagttcttaaaagtcagatatttcagttaatattgtgattatatagttgattttgatgaacatgttcatctaccagaaataaattatacacacacattgatatggttaggctttctgtccccactcaaatctcattttgaattataatccccgtgtgtcaagggagagaccaggtggaggcaattggatcttgagggtggttttgcccatgctgttctcctgatagtgaatcatgagatcagatggttttataaagggctcttcccccttccctcctcactcattctccttcttgccaccttgtaaaggaggtgccttgctttctactatgccctttctactatgcccttcaccttctactatgattgtaagtttcctgaggtctccccagccatgctgaactatgagtcaattaaatccctttcctttataaattacccagtctcaggcagttctttattgcacatatatgtgtgtgtatgtgtatgtgtgtgtgtgtgtatatgtatgtatatatgtatacatatgtgtgtatatgtatgtatatatgtatgtatatatgtatacatatgtgtgtatatgtatgtatatatgtatacatatgtgtgtgtgtatatatgtgtacatatatatatatatatatatatatatatatatatatatatgaacagagagagagagagagagggaggaagggagagagggagggaagcatggagaaagagagagtaatagcctaaatagaaataaaactagctccaagtacaggttcgtcaacactctcctatcatacccccaccaaagttaatgttaaccacttggagccctgttcttccttagttgtggagtactttagcaaaattttaaatctaattatgcctaattcaacgacagtgctaatttgaaagtgttagaaactgaagacctataataataatgagagttacaaaacataaatagtgagacaatgatgaatgtagtggatgcatgtacgagggctatcatttgacagtagagatgatgctcaaggacagacaatgagtctttcaatgtgtggagaatgtgctgctgttacagtgatgtacaggaaagaaacaaaaactgaggaagtatcagtaaacaaaacactcaaacatatgagtatacagctagaataaaagcaacagtactagatgacaataagcccaatgttaactcagaaagcagaaggtttttaagaatttggggaatactgtggctgatgatacttatgtctcaagccacagatgccatatgggctctgcgcccagttgaatcggcaccacctggcagtaagtgggcaggtccacgactgccaggacatcccttccaacacttgtggagatcaccaggaaggggggagagacctgccttgacagattttcaatgtgggcgaaacaggtctattttgagaaaagatgttcaatagaacatatgtcagcaaggaagaagagatgatgcttagttctaaagctccaaagagctggcttacactccaacttggggaaaatgcatccgggaaatgcaagattaatctcatcttagccattcttttgaatggatggacatgacccctttctacttgaagacagaaaacataaccatattgatttcaggttttcttcattggtttccatttaggattgttcctccccatcttctttctgtgtaggcatcccagttcccaagtgttcatgaagcacgtatggccttcaggggatgtgtctgtatacattgttatcttatggatgcacggttttgtctgcaccttggttctgaatgtctttactcttgagcatctgcccatgggtccccttctcaaggcctcaatttcttgagtttaacactgcatggcccatgcagcttttcagttaagcatctcttgctatgaccaactcttttcctcagtcaactcccacactcttttcagggacaggaaaaatgtagccacttgctggctgcactctgaggcctcaagaaatttagtgaatctgcctttgcccttcttgctgatgaaatactgccacatcaggccccctcttcggaaacctacaagcatctaattttcttgcttcctccccaactttctttttgactcccccccatccagagagttcttatgtctactgtactaggaaaaactcattcttaaggtatggttttcaaatcattctctggtctggactttagctacggttttaaatgaagaaacaacccagagccaaaatataatgaaactatttccttcttccacagagtggaaactgctttggggttaaagggccagtgaaccaaatagaaaaggatctcagggaacacagattgaagagagagaagaaaaaatatgaaggcattgttggttctcttttgagtttaaaatctagtggggattgtaagcacacacacatatacacacacacgcttacacacacacaccagtgaagttatgaaggattttgtcactccaacgaccttgaatttgattatctaggtcagttgttaccaaagtggaatgtacatgcccaataatatgcgtgctaaacagttggggtagtgagaaaaaatactttttatttatcttgttctctagaaattaatattttgattgtatattttatagtgtatgtgatgtgtaagttgtgtctacaaaactagtgtcaatgtaatttaaaattacatatgtctgtgaatatatatttatatagggtacatgcttaaaatgtgtttacttctgaggtacatgaacatttttcccccaggcacagaaagacaaataccacatgatgtcacttaaatgtgcaatgtaagaaaagttgaattcatagagatgtagagtagaatcatggttaacagaggcttgggaggtggagtgagggaatagagagttactgttcaaagattacaaagtttcaactagacagagggaatacattttgagatctatttcaggaacattttgagaccctcactctaagtaataggaaatcattactttagttaacatatttgaatatgagttgtgatgttctatatcgtttatttggattctactaacccacacctagatttttatggcattacctttttactcactgtgaatatcctactcatagacagatgccctgggaacttggacttgaggcacccaagaactgagacagtgagatttgggggcacaaggatctatggataagttcatcttagtgatgataaaatcaatttggcatgtttcacggacagtgtgcattttagaaagggtaaagacttggaaacgggatatttttgagcccaagtgtttccaataaatagctgtataatttgaagcaaataattgattttttgttctctttgtgccctcgcctgtaaaatgggagaaatgtattcctttctcatccttctcatgaggccattgagagtatctaatgagatcagactgtgacatagcataataattctcatttcttgaaggcctattatacactttgcaagcactgtatgtgttgtttctacttctcttgttcgtttttcctggaataaatatccccccctcctttacattggattgccattattcaccctgtaaggaaggcttcatggttctcattttcatctgagaaaacttaggctcagagaagatcagtaacttatctaaaacacacacatacacacacagacatatctatgcccattattcttaacctagtttctctattcaggagttatctctgctgtctctgcttctgattataatctgtgtaagctgatccaagtgacacgattacagggaaattgtaagccctttgagagcagagactacctattgatatctacattttaaaatttgattttagccaacctgtttatatgcaatgactaacaggttagtttgacttgcaataaatattccaaatcctagactaagtaaatttattaatgtaatgatttaacttgattttttcattggcatgtttccctgaagtcgtcatgcaaaattgaaaaaaaaaaaagtatagtgtgtgattctagattgaaattcaggaatcctccagggttaccttgtttgctttccaaatagttcagattgcttagtctgaccaacaaggtccctgacacttggaactctgtctatccctctaattgactttgtccctgatgacctcgcccagagatactcttcaccccagctatactgtgttgctagagtttctctgatatcccatgctattgtttcctttgttctcttcataaggtaccatttcccacccgccaactcctgttttcctgatggacttttgtttcaccttacaagatcattgctaatgtatttattttgagaataaaaagtgtaggaaaggtcacgggacaaagctgtacaccagacctttcccagacgaacctagtgtataatctccctagtccaacatcatggcttaaggcagtcgatagatccgtcttaatgtcccttttgagttttctactattattatatgaggatttatttttgtctgaattcctccctagatttgccctagagagcaatgactatttacagtttattcctctttgtatctcttatgttaaggccagaccttggcacatattctagctgattagaagacgtttgttgaatgaccaagtgattgaacaaatgaccatgtgctctgccacagtccggtcagttctactttggtttggttatgtgtttgccacattaaagttgtagcctgggaagttcagttgtgagatgtctgcagaacatgaaaaattggaataatgaggttatttctaaaattgctataatttaaaataaatagtggtttattccatatatgaatatacactggaaacaaagaatttctagaatactggagattcaatgataacatcattgaaattaaataaataataggattatgctagttactttctaatttactagaaattgaccgtgtgcatggcacgtataatgagtatcatgggatagttacaaaaagtggtgcttagtgagtttctgtggaaaatctcggtaccaataaaacggaggatttccagaaatcgatattcctcaaagcttgacagtatttatgcacggttacactttgtgtgtctttcgtttgaatcaatggaaggaggctataactgaaaattattgttttagtgtattatatctttaataataagagttttaagaatctatcattagaaataattattcctcaatttgtaattctcaacatttgaacaaataaatgctctgtgtctatcagttaatcttgcccatgaagatttaataaagcacgctagtttttacaaatgtgattttagagatggtcattacttggtaaaatattttgtgttaacacttccatgaatatgttctgtgggaatatactgcctccacattgcttgctcatgaagacatgatttttcacatcatcctatcagtattttgagaaagagattgatcccatattctatgagcatttgaacattctctagtatttttgtttaatcattaaaacaacccttgaagtctatgtgctacactggttatttccctcttgactttcctttacagataaccctctatcataaacaacctatctatatttgttgtctccacatcatgttgccagccctgctttaacacactgcacattgacttctagcagcaaaggctcatgggaggtactctcatcaaggacactgatggtcctcatgttgctaaatttggtgggtcctctacagtctttatcctagttcaccttattatggaccactgtcaactctgttctgcttaaaacactctgttccttgcttatatgactctacactcttaactcctttgtgaattcctcatctgcccttccattaagtattgacgacatccttcatagttttgatctaggacctcttttcctcttacttgacattatgtgggtaatcttgtctttgaacgcaattaccattcttatgttgatgacccttaagctataattccagcccaaatcatttttctgaggaagctacaagaatacacaaatgtctaatagatctctatttagatgtccctcaggtgcttcaagcttaaaatactcacctgagctcatcacctcatctataaattctgcttctcctccctggctccctgatttatttaatatgaccaccatccacttagttgaataaagcagaagcctggacaccatctatacctccaattaatcactaagttttgttgttaaatacgttcttacattttctctctagaatgtcttattttccccatctttacacccaaaaccaaaagtcagatgaccctgatctcctgcttagatttcaaaacactatctcttgcctagactctggaatttcagtcttgctcctctccaatctatttctacaccctagactctggaatttcagtcttgctcctctccaatctatttctacacaaaagctagagtaattttttaaaaaacaaaaatctgaatgtgttcattttctgcctaaaagccttcagtaattcttatttgttcttccagggatagagtaacaactttcagacctagtttattagctagttctttaaccacaaaggactctctcacttgtctactccccctaacacacttcgccctaacctttgccattcctccctttcccttttccttcccagatggacttaagtcctttcagattcttaaatgtttcttcctccagtctcttacatctcttttccttgtaactctaaaaactacttagcttacgcaaggaaaaaggtctgtacaattcccggaatcagcgatcctaacgttccctgttgtttttttcgttgggacatgaattcattcacagtggctctaaacatcaccacccctgcctatctctcccattcctactttatctgagcttatccatactcttgaagacttacatattttttttctaccaggaaatcattactagccttattatcccactgtccaaaccaataagtctgattaggtatctgtatatatttaatattactatatgtgtttttctaacactctagtagaggagaaggtgtatttctttctgttttttagaagcctgtatttctgctattatagctcttaaggaactctcatgcaattgcctactagaatgtaagttacggtaggataagaactggatcagtcatatcacacatccacatataggacctagcaccatatctaacacacagcaggtactcaatacatttctttcccaaataactaaagagtttaaacaaaccaaaatgattaaatgagaagtaactgttttggtaattcttgtgtccttactagagtctaaattgagtgatttttatatcatcagtttatactcccctttcccaaccccaattctttcttttttaaattttttaaatcaaatatgccttaaaacttcaggatcagttgagtaaaatgatgcttttgtcgtcttttgcaaaataattgtatttcagaattttgatttagatattataaacacacctaaaataatagctttagtcttaagatgaagtgcttcttaaactccctaagatgggttggactatggatatgaacatggacaatatcacattaatttgtgtacacagttctaacacagggtctggcatataagaacaagtcagtaaatagttgttgaatggaattgaaaatttaagtagcaaataaagtattttgacctacaaagcaagaaatcacatttttctttttgtcacagttccttaggaagataattaattttttagtatttaaggatgttaaatatttattttatgttctatttactaggcttctttttatgaaaattaattggtgaaaatagcgtacatatcttcctttaccagaacatttacattttgggcagtaacgctggcttttgttaaaaaagcaaaatatgtgtgaaatttatgtttgagttgatttcaatgcattacatttccattttaaatcttctttgaaatactctatttttgacaccatgaaactgtattagatcttagtatgttagcaatgttttgcagttttagagccataattattttaatgaccactttcagcatatacgttttctacaggaaaaataatctcaagaacatgaaaagtgaaatctatattttgggtttcaaaatgatacattttagctaaaatatcatagttttaatttctcagtgaaaaatatagtgtggtaatttatgaagagactcagtgtttaaaaattatgactctatagtcaagtttatgtttataggacataggttattcaattacatttaaaataattaatttagaaaatgtgatcaatgtaacaaattttacctgttcttttctaaagctaaatttgttgtttgaagtgtttcttctaaaatgctaatgaactatcaatttaattgttgagcttagagttagaaacttaattatattgccagaaataaagaaacaaatggatcccaaaagattcacacattagaaatgtatgccagggaaatgcttttgaatgtgttcaagtcatggcttctaactcgtaacttataacttgtgttatgtctggcttcattcccttaagaaaaaggaataataatgccttcggagagcatcccagctgtaagagctatgcattggtgtctaaaaaagcttctcactcctcataccatcctggtctgggaatttaaaaaattgtcatcttttgataatctgtatcacatagtcttctgcatagtcatatgaggttagaactgccccataacttttgcagggcctatagtaagtgtgcaaatggttgcctgcatgccacatatttaatatttataaggtataaagtcaacagactattaaatatatcctatctgctttccttgacaattatacaatcataatgatatggacatctagattcgatttagaattctctctctctcattttctttttcttctttctttctttctctttctttctttccttcctttctttctttctttcttctttctttctttctttctttctttctttctttctttctttctttctttctgtctgtctgtctgtcttgtttttttaaatagtgcaagcagtttattccctggcaaggaatttggaaaaaactcaaatagcaaaccacttgatacaataaaataaattccttagagttttgtactggaatgaggcagcttggttagagctaaccctaagcctgttatttaggatacattggcttttcttaagcttaaaaaaaattttactgtgttaatgacatttaacatgagatctatcatcttaataaatactacatgcacaatacattattattgactctaggtagaatgttggacagcagatctctagagctaattcatcctacttaactgaaatgtaatgtctgttgattagtaacttcctatttcgccctatccccagcccctggcaaccaccagtccagtctttgattttatgagtttgactgttttagataccttatttcaagtaagtggaatcatgcagtatttgtctgtgtctgtcttgtttcacttagcgtaatcttaaggtccatccatattgtttcatattgcagaatttccttttataaaggctgaatagtattccattgtgtatatataccacatttatctattcatctgccaatgggcatttaggttgtttctgcatcttagctattgtgaatctgttgccttttttccctacctcctttactccatcctgcactgtgaggaactctgtgcacatagatctggtcgccccatttcccacccacatgttcaagtttttcccactcacctcatgcaaagatttaccccttagccatacccagtaactgactttgaaacatttgcccagggagttgagggattctgaatgccagatcatgggagcggggcttctagtgagcatgttggcttggtcctacagactcctaatcagagctttgcctttgaaagcatggggcccaagggcaaggaccctacttgttaaggtctaaattttttttctgaaataaccacatcgagcttttatgtgtagatggcctaaattgggctaacccagaggcagtgacactcaagtagtttacatctaagcgctttccatgtgcttcttttcccatttctgttacttcttacaaaataaaaaatcagcatctcaattaccctgatttgatcattgagcaatctaaaaagtatcaaaatatcacatgtagcccccatatacatacaactgttatatatcactataaataaatatatacacattatatttaaaaatcaatactttaattttacatgtttaacaaatcactagcatatacattccagattgaacttacgagggatgtggaaaagattcagtgactaaataacaataaagtactctaaaaatgaaaatgtgaaatggagacagtataaatctaaaatcatatcacttatgaagtattgtttcaaataaacaataaaatatatcttcaatcaatttaattttattttagttgtataaaatctttcggtcagcattaacctaattggaacactaaataggtacatctaaaaaatataatcccccccaaaaatatgtagctcataagagataatgcattgaacacagataatattggcgttaaaaacagaactctaccacatttgcaacgaaatgtttatctgttcttcctactagaaaataataaaatagttctgcatgagcttgaactcgaagtattaggtgtacaaagaccttttagtgaatgaatgctagctgaaaagcaaattttaaatatgaaaaattagcaagacaaacatttgaatttgtgggagatgagtaaaactcctataaaaatgaattgtttagtgttaaacagattgtgtatgaaatattaatggcatattgtcctgagctccccttccgctgtttccatgtagatgactgaatttcaaacagaaatatgccaggaatgattacgtgaatgaatattactacatgagattgcttaaagagtatttcttcttttgccttctttttactttcgttatttcatttagtagttagaaaatactgtctacaaatatgtgagaactgcttaatttatttttgagacattaattaattcaactaaactatattgactgtgtgagagagattcccttggtgaatatgtggatttttgcggtggtaagaactctcctctggagcgcaaatggtattgctctaggaataaagcatatacctcaggcccagatgaaccagtgcaatctacagtaacaggttcaaagatgacctcatgacctactgtggactaataaaaatcaaggagacctactgcaaaggtttctgggaaattctttttctcttgcgttgaactaagtaatatacatatgtgatagttagagctgcagcctttgtaataccatgacagaagataacctgaaataaggctgacagacacaagagggagacctaagagtactgagagatatggagcaggaccccctgattgaacttcacttgcagcccccttctgcagttttcaatgacgtgaaccagtagaatccctttgtttactgtttttgattaatttgagtgcagctttatgttatgagcaactaatagcatcctcactgtcacaactgccctctatacggcaggcactttgtgatactaaagaaagcagtatacagagtagagcccagtgaataacagggcagatgttgcaattaaactgcctgtttaaattctagctcttccactagctaacttgtgactatctaagtaatttaaccttcctataatcatacctatcttgaagacttgttgtaagatttaaagcacaacagtgctactataaaacaggtatacagtaaagcttagctacttttttattaggccatatgatatcatttcattaaaatcttatagccatgctataaggtattatgatcctcaatttataaataagacagctcaagttttggtcaagtgactttaccaaggtcatagagctagaaaataatgattccaagttacaagccaaacctcttcaatgccaaatttacatcatcccccattacttgaagtgtaagattcacatggacagaaatttttgactgtttgatcactgctatctccttatcatctaaaacagtctctggtccatattaggtgttcaataaatatttgtagagtacataatttccttcacagactccacaatctggtgaaggaggcagacatgtaagagaattatttcaggattccacagttgatgctgtaacagagctaaatataatgaatggaggaggaatgaataagtttgtctgggagcaatgctatggctattgaaataagtcttgctcatgctttgattgaaatggtggatatagatcacacaacaaataacaattagataacagcttgttgggagaaagcgaggatcagtgtttgccataaacatttctcatagctaatgtcaggtgtttgatttctcaacattttatatctttgactttgattttctctgtttttattttttaactccattctcaagaagtctgcacataagagtttcaacatctagcacttcataactccgtcatctcctctcaggcttagagcaaattctgagacgtggatttatcgtcgagtgatttcttcctggcattttatctctgagaccaggatctggttgctaagcatgtagacatagaaatgcatttcttcattgaaccccataggttcaaactagtggataatgagcacaatgtcaatgtgattatttgtaatgggggaaaggttaccggagaatattacacgaccatccacatagactaacattttcctcatgactaagtttacttagcaaaacaaattaaaaacagaagtttgtttagcagcacagaattgaaggaagacaaccagatggttatgaggaagattcatccaaactatgccagaactgaaagaaattaagttcattcagtacaagaattgtctagaataagagaatccattttgtgtcagcacttcccaagttcttgttaatgctaccttaagttcaattcaaaccaggcagcatttattacgtgttgtgctgggtcctaggaggaccgcgttttaagaacttactgtgatcttctagatcaagtttttatttcaatatttctacctcatttctgattcttaggtgttccttatttcccaatttatcccctgcagaaattgaggcaataagatgtctatcttattgcctatggtgttgattatttatgttatattctgttttgtgaagtttgacctctacctaattaaattacattttcaattgtatcttggattgatttattcaataagtattctttaatatttttgcatgaggtcggtcaggtttcatcagacattaggaattaattataaaaatctctagattggtacttggagcttaaaggaataaggtggtggaacgttaaatgaggaggaaagaaccagcagagctgggataaaattcatctctatcatcttcccacctgcttgatctctggcatataatttactatccgtgaacctcaggtttctcttcagaaaagctgcagggttgttgggggaaataaggcaattcctgggcttcagtatgttcaaaacagagcattaatattattatagacttttgatgatttacacaattttagctttttggcaagacatatttactagtactaagtaaaagcacgttgactttctaaaatgaaaatgtgtatgtgaggatgaagaaaaagaaagtgttttgtttgataatatagcattataacactgcacaaaaaaaaaatggtatatgcagagacttccatcacttgcttatgatgccgcattgggatctcattaataagacacttcctcagacacttcctttgtgttcaataaatttcaatttcctcctttccttcagttcacttcaagaaggacggcagcaactttcttgttgccaaacctgacaaatgttttttagtgctgattatactcgagcattctgtagcaaaatgctgtgggtgaaaatgccttccttcttaagggaatttagcttctgtagtaccagaatctccttgttgaatgaacatgtactgcctaagtcttagtaatccctcctttttgagcccattttctggcatctctccctttaatattcctcaaaaagttggatttttcctggacttttcatattacagactttcctttggtcatcctcatccattccgtgattccaactacattttccctccatcctggcatcttctttcttccagacttgtatatgcaactgcttccattcatacacttgaccaaccttttaatttctataagatcaaaaactcagctcacaagctttcccctaccatcgagcggggttcttcttttgcttctttgtttcagacaatggcaccaccatactcgagtaaggcacgttcatttatcaggtcctaccaaatctacaataaactctcttgaatttatccacttgttttcatttgaacagtcatttctttacctgggtagcctgcaccttctacctgcattgattcagcagtctcttcaccactggctctccctccctctcctgcctctcttcttgctccttcaatttattctctactcttcatagtgacttttattaatgcaaatatgaccttataactcccttgcttaaagacccactcatgtttgtctttgtatccataacttccggcctagggcttaacgcatagcaggtgctcagtaaatctgtggtagatgaaagaacaagttgtataaatactgaatggtctgatgtgctctttgttgtgtcaagaaggacattttgcagtcaggatagctacatcagtcctttagtaggcatttgacagcactcgcattattcctcaagagaagatggatgtattgattctgtatttcaaatgacataacttttgtgaaataagaggctgccacggtaatctgagggatctctcaagttcaagggactccacagtgctttgtgtaaggtaacaggctaaagggttcagtcttaaactttcttaagactgtagttcagggttcctatggtggggctataaccctgaattacatcctctttcatttcatgctgataatgagaactacaaaccaaggggtattaggaaagaatccaggtttgatgcagggaaaaataaaaacaactgataatctctagtgtccccaacttcaagaattcctttcttctttacaccaagctttttttctctgccaggacttactttgtcttctacatgtttaagggagaaaaatgagttaacagaaggggaggtacagcatttctatttacttagatgctagagaacaggatgaaaggtatgaaaaatatgaaagtctctctctctctctctccccagccttcccccgcttctctctctctctctctctctctgtgtgtgtgtgtgtgtgtgcacgtgcgtgtgtgtgtgtgtcataatactcaacctttcttttctttcaagcatatgttgtggcagagacaagtgtacatcaaaattcgtggtccctctttcatagtatagagttcttgctaggatccagctgcaagccagcaactacatttcccagccccactggcatctagttagagccatgtgactagttgtgaccaattgaatgtgagtgggagttatgttgcaggcataccttttccatcttcttacttcccatttgctaaccttatggaaaagagtcccaaagacctaggagatgaaaaagcctaaaatggaaggactcagagtccctgaattactgggtagagaaaagctgtttgcagatgggaatgcccattttgtagtattctttcttttcttaagccactaaaattgtgggatctctttgttatagctactggcattaacctcttacgtatacatacagctatgtgctacaaagaggaatagatacattttttaatcgttgaaaggggagaaagaaacatatttaggaggaaaataatttagtctctacaattgaaaagtgttttatgaataatattttgttttggcagcatattaaatctcaggcagctgaactacattaattttcaattctctatatatgtttttgtcttcagggtttagtaacactgatatataacagtttctttcttttaatttccaaatttaaatgtctaagtttgccttctaggcagaaattaagtcccattgtggaatgagattggatcaacacttcaccaagatcattttagttctttgtaatcttaaatgaaataagctaataaagcattaaattagcatgttgtaaaacttcgtgaagttttaatatgcttctaagtggcagctcttagcttattatctctaaagctaaagtcaaaataaatgtctcagttgatgaaatggagatgaggcaacattttatcaaatttaacaaaatattttatatctgaattataaagtccagattatctagtaattatcatataaatgtatttaaccagacatgcatttttctctaatcagtagccctggagtctttggaccacaaatgtgccttatctcaaatgctttaactgtgacattttgctttagactagctcgactacttctacagaaattatacacttcattcacattcatccagatgaaaaaaatacatgtagaaatgatcataataagtaacatttgtttaggatttcagagtttacgaagggtttttctattcactttctcacttgttcttcatgtaaactggtttggtggacaactgtcattatccctgttacctggagcccctgggtcttagggagacttcttgacttctcaaggtcatgaaggtgctaactctgaccgtgtttttattcctactgtgccacacttctcaggtaaaaatcatattgcagacactttaagagaagtacttaagaaaataaattcctccagagaattacatttaagttgtttcattaactgcagtgcataaagaaaggaaaagtgttcccaaacccatgtagtattttgctattgcttatggtaatattctgcacacctaatattgtcagcataattttccatgtaacaaaatgtcctaaatcagcaatgtccaatataactttgtgtgatgataaaaatgttctgtctctgtgctgtccaatacaacagccactagatacacatgactactgagcaatggtaatatggccagggacactaaggaactaaatttttatttaatattaaataacgtttaaatttcaaaagccgcatgcggctagtggttgtcatcagatactgcagttatagaaaattagaatttacctctttaaatactaaacctatttttaatagtaggatttttaaattaaaatagttctaagtgcttttaagtgatacgaagtcaaatgcaagatttctgttttaatagtactctcaacccagagacaatcttcatgcatccttatacatgttctttgttgccttattctagttttattttaacattaaatgcctctgttctacttgatattgacttgcttcagagaacaccaagtatagtggaaagaaacacacacatgaggacttgaggctaccaaccaggttcaactaaatgcactctgatttaattgtagtattgggatcccctgttgcatttattgaagaagaaaaaaactttgcaaccaaaaagatatttgaaagcaactgttcttcttggacacatgatccctcataaagtggggcttcctgcttttcagagacttaatttctgttcatattcatttcagcaatagtaataatgatgatggcgatgatgataataatcatgatgatgcctaagtgttgtagtaatgcttcttctgagccagacgttagtcaaattactttctctacattaattcaggcaatcatcacaacaatcccacaggacaggttttattattatacttatttagctagcaaatgatataactaggttaagttacttgcccaaggtcatactgccaagacagtggctctagtgtccctgcttctgaccatatgttatgctgcctatcctagagcttttctcttctaaaatagtaaaataatatattctttgtttgtttcatacttttttttttttttttttttttgagagggagtttcgctctttcgcccaggctggagtgaggtggcgcaatctcagctgactgtaacctctgcccccaccaggttcgagtgattcccctgcctcagcctccgaagtacctgggataataggtgcccaccaccatgcctggctaatttttgtgttttcagtagagacagggcttcaccatgttgaccaggctggtctcgagttcctcagctctggcagtccgcccgccttggcctcccacagtgctgggattacatgcatgagccactacacccggcccatacataaatattttaagcgaagtacacatgcatgatcatcatacttttaataatttcatttaactgtttccaaagaatgttagtatgaggttttctttttttctttttataatttcaacttttattttagattcagcgggtacatgttccctggatatagtgcatgatgatgaggtttgctatatgaatgatcccaccacccaggtagcgagcatggtaaccactagttcttcaacccttgcctgttcccttcctccctccttcctctgtagtccccagtgtctattgttcctgtctttatgtccatgtgcactcaatgtttagctcccacttttaagcgagaacatgcagtactcgttgtctgttcctgcgttaacgtgcttaggatagtggcctccaattgcatccatgttgttgcacaggccatgattttgttagtttttatggctgtgtagtattccatggtgtatacgcgccacattctttatcctgtccaccattaatgggcacctaggttgattgcatgtctttgccattgtgaatagtgctgtgatgttatatgtactttttggtatattcaaagagaaatgctattttcctcttgacatatttatgtcaatttaacatatttatgtcccttttctttttaggagcaccattctcttcctttaacattataaataaaatattttttgcttttctgtttttgtaagtgcagttttattgacagagtgagacatacacgtcgatattgtgactagctgcatgtcttctattatttagaggtctcactcaaatgtagattatcaaattctgttagtgaagagggtagaacagcagaactaatgctggtttccttctctagcattatttgatgataaactaagatgataataccccccaggtcttagatacctgcagtaggacaggcaccctacatttaatgctcctaggaatccttcaaagtgatagcatagttattatacagtaattgagaaaactgatgttcataagttagaaatttttccgaagttgcaaagaaagtgaatggaagaattataccaagttctggccgggcgcagtagctcatgcctgtaatctcagcgcttcaggaggccgaggcgggcggatcatgaggtcaagagattgagaccatcctggccaacatggtgagaccccgtctttactaaaaatagtaaaattagctgggcgtggtggcacgcacctgtaatctcagctactcgggaggctgaggtaggagaatcacttgaacccgggaggcggagtttgcagtgagccgagatcgtgccattgcactccagcctgggcgacaagagcaaaactccgtctcagaagaaaaaaaaaaaaaaaaaaagaggattataccgagttctctttgattccaagcccaaacaaatccttttttgcaatatatgacattgtttccctgtttgcattccccattctgtgtatcacacatcctgtggcctgatcaaaattcattttcagattctgaatttattttccattgaatctatataaactataaagacagaagatatatgtatgtgtgtatacccacgtttctcttccagtgtcaactgataaaaatagatttcaaagtctcaataacctttaattccctttttctcttaaaaattctttagaacttgtacatgacattctgactctagcagattttagaaaacagagaggccattagatattcataccttactattcagatgaagtattcaatgctaaattatgtaatttatctgctttgcaaattgtatggtcagattgagttccacaaaggagagataatttttaatataggcattctgtagcttccctaattattgaattagtttagagcaaaatccttaaattgtatcgttgctatgctcaaattttgtatacttgtccacgtaggctatattaagatttcattgaattttggtttctttctcagtgataattcaatatatcaactcaccactcagatttgcctttgggaaaatccaggccccttttctggatttttagagcagattttaaaaaagtgattctgtatatgtgttgaaattaaccacatctcattgcttttgaatgattgaggtaatgtatacctactactttaaaaaaaatgacttacttagaaggtgtccatagttttataagttccattgaactggtttatattgtatttagaaaggaaaactactccttttatccttaagggtgaaaacctggattttattatacaattaacacatatttattttttattatgaaatatatcacaatataaacgtttacagggagtgtttaaagtggtgttgtccaatggaaatataatgtgagtcaaatacgtagttttcaattttctactagccatattagaaaaagaaacagagaaattaatgtaataggatactttatttagcctagtatatccaaatcacaattatttaaatatgtaatcaatataaaaattactaattatgtatttaacctttttctttagtaagtctctgaaatctagtgtatattttacatttatggcacattgcaatttgcattagtcacatttgaattgttcaatagccacaggtggctaatggctaccgtgttggacagcacaggtttaaagaataatatgaacatctgtgttccaacattctgagtttcaaataagaagaacaccatcagtattttgggagaagctccctatgttaccccttgctaatcaccttccttccccccagagccaaaagtaaccattatcttgaatttctagtaaacaatgctcattttttaaaaaacgtatgttcaacacctgtatttgtatctttaaagagtagctagttttagtttgcctggatttgaactttatattaagggaaccaccccatctctaatcttctctgtgaattcttttctctcaatactatgttttacatatttacgttcatcaatgtgcaactcattgtatgtatataacacaatgtatatattttacatgcgtatggacatttgggttgtttttatgtttttgttcatcacaaaccacaacacacatgtgttcttgtatatgttttatagtgcatgtttaaaaatttctcaacagtattcgctagtagtattgtcaggtcatagggtatgcacacataaatagaaatgattgattagctgcaatttgtagtgcacacatatttgctatgtaagtgatccatgtttaagactttaactgaatttaaaaaatattttattggagccaatctaaatgagctaagggtttgtattgtttacataagcaaagattacacttactgggtcaattcggttgattaactttggatatataaaatatatagctagttgttaaatagatataattattaattggcattacttttgtttgtatataaaaatttcaaaatatccatgacttaagcaaggtaaacacccactgggtggcttaagcaacagaaatgtatttcttgcagttccggaagttgaacgtctaagattaaggtgatgacagggttggtttctggtgagtcctcccccattggcttgcagatagccgccttctccttcatgacctttcctctgtgtatgtgcatcccttgtagctgttcttccttttatgaggacattagacttattggattaaggtcctacccatatgaactcatttaaccttaattacccctttaaaggccctacctccacttgcaggggttaaaacttcaacatatgaatggggttgaggagacctacttcagtccataacagtttctatattctgaagatggtctttaattaactaaacagttaatgttactttactgggaatgtcttttggatgggggaataagctgatgatatgagaagggttggtgaatttctcataagtgtgaaatttgttgggccggcccagcatgattttcaatcaaatacgctttggggacaagtaggttgaatcactacgagaggtttaaaagaaagcaagttgtaattgcaacttttaattgaaagaaagacaggctttgttgatgtgccagcaagactgataactggctttaacgtagatagtaaggcagcagattcaatccactgatcgtgatctactagtgaatttcaaagccttatgcaatagaactacaaaccctttccttgcccaccttgcaggtggatccataggcaaaatgaacatttgcaaaaaagccgctatgtttcagaatttgtgctagggctttaatatctataatttctccaaatcctcacaatttaagaattaattcaacttagccccatgaatagggtgaaaattctgagatttaacaaactaaaataagttatctgaagacagacaaatagaaagagttgagatattctatttgaatgtaaaattttcaaaaagtagaatgacagcgtcaggaattacagtctcagtgttgaacacaagacttaggaacaaatttgctgcatgtaatttcattgagatgggacaaagtacagcatacgtaaggaagttttagaacaaataagataattattttacgagctttgaaacatgtgtaagaaagatacgaataaaagtataatcacatttgactaaaacatgaataccttaaaactgaaaagcactgagattatcattatataattttgaatattttaaaccacaatgctttgggagtgcactgtaatattttagaattggaattttaacttactggcttaaaaagtaatgtactttgttttaaattcaaagattatcttgtaaattcagttcgatctattgaaaaaattataaaattcggcaagaagccaaagaagaacaattatgtagctcaagataattaaattttcatgtttggctttagaaatatattcgtcgtgacatagtacatggtaatctagtgagcccagacaagtagttttctctttttgtcaaagggaacaatttgatgcgtgttcaagttgcttaaataaaattttgtatgtgctttctcatcacaagagaacaatatgatttttgaaattatttttactttataaaagaaaaaaaaaagccctcacagagaaaaaagaaaaaaatgatgatgtctttgaaaaacaaagttaatacagctttacatatatttgacctacatcagggttaatatttttcaaggtgaaacattagatgctggaacttgcaaaaacaggcaatcctcctttagatgaaacggacactctaagggttaattcattcactgagacctattgtgaagtaagccctacagagactgaaaaagttaaatgcaactcacaaaagttgctagaagagtcatgatgttaaaataaaataagtacacaatgtatgctgcaagtatacttagagccatgctaggtgcggttgagaagttcaatacaggtccaagataatagctgcttctcctatagaacatgtcttctcattggagggataagacctgtgtctatgaaacaggcgtaattacatagctctggaactatatatgccgaaataaatgagacagtaagtgttattgtactataaagaatgaagaaatcatgatgagaagtaacagttaatgaatgttttctagaaagagtaggatctgaattggccttaggttgtaagcagagtttatagatagagtagtggtatgtcagagtcactctgggtgcttaaacatacaaatccccaagtctcacccaaatgtgtcttcagatgaaaggaaaaaacaaatgacttgagctcccccgcaaagaacacgggtggtatattgagcagccaaggagtgaccagagtggcaggcccatgttgagggacaaaagaggacaattagaatatgattaatacaaatttacagtgggatgagttgttagcctgaggagcttgaatgtgaacctctgtgcaaaaaggagtcattaaatacttttgaaaaaggtgggatgggaagaaaatgacattctcaagacaattagatcgaacagtattaagcatgctgacttattaagttatgcaccttgagagggtggaatgagggaaaagggtctttatctggagtaagacaggaagaagctaagctgtaattcttactggactgtaaattatgtgcagatatattatctgtcatgttcgtgggcgcattctcagtacatagcacttgaaacaggtactcgataaattgtcaaatggatgcatggagtgatttccatgcaaaatctaatattgtatagtattagaagggggaaaaaagcatggcattatgctagcagaaatgtcatttggtattgaggatgaaacattttcaacagtttgcaaagccatccactcaaacattctgtcactttccaataattttgaaggatgttctttctacttctaccttattacacaatgagttgagtaagataaagaagtcatgtgcaacaaaacagagggagattttctgaaaggcactacaccaggaagttgttgtactcttgcttcatcttgccatcttggatatacttctggcgctacctccaggccagttcctcgttacatatgtcatttacttcccacatgctagactcaccgagttaatcattttgctgcagttaacacattttagcagagtgtaggtttatgggtgagaaggaaatcaatgatgtttcaatacagggttcttttcccatcccccttatttccacttagaactgtctctcaagtcttaatttgcctctaaacttttttcccagcttacattcttttctgaaaaatgcaacgacgatgccaatgtttgttgacctgaaatacattgtaaaacattcataatactttgagcagagcttccaaactcccatttgcctcttttatctcccttaccttggcccctttttgaaggcaatgtgatatttaatccgtttctattgatgcttcaaaattattgaaaaactggtaattgtatttttccctttacttatcagttgctagttgacaatgagtgtttgcccaaacaataaccaatcaaaaggtaaaaaggagattccagacatatctgagaagaaattctttggaagaagcccgtaaatggaatgggaattcaaacaaagccgtttccaaaagaaatactaaatggtctctaaatgcaaaaggattgctccccaagcattttatgggagcataaaaagctcccaacacattttatgacaatacttctactcaatgacttcttgtgttgacatatttgttgcactcgacgttagtatttacagcttcttatcccaaatatttacttaactgaagccctgatgtttttaaaaacttttcatctgtgtttaacagcccattttacagaaacttatttgtttcatcaggcagatatttactgagaacttgcaagtgccatatattctaaaaatgctgatgataaaactgtgaacacaatagattctcatggtgcttatggtcagggctagcacacacacttgtgaaatgatcactgatgatcaaaggcataaacactacatttggaagaaataccgagggatccagaagtatcttggaaacactagcaagtatagcagatggtgggattggtgcttcaaagaacttcttgtggaagatgttacgtatgtaccttctctgtgccaggcactgctaggaagtgctggagagaaaaagatgtgctagataccgcctctgtcctatgtgcttgtgctttgtggggaggtgagtaggataatcccagttctcatgcagtgtaatgagtaccatgacggaaatgcactccaagaactaggcagcatgaccagagataggacatttgagaaagacttcactcgggtggtactatcttagtctgggtgctaaaatagatgtgatagatgagtaagggtgacccggaagcaggagggaaagggaggggctttcagaacaacaagtgcgaggacattaaggtgaaatagagtataatagtattcccagatccttgggattgttctccattaggctaaaacaaaggtgttttctcttctttaagatttcatgactgcagattgcataacagaaggtcatttaatagacctctaaactgaaggaattcttgaattaaatcacaacatatcttccatggccagagaaaccattgcctccttatgtcgacattactaacagcaccagcacctgctgctcaggccagcgggagggttgggtgttgctgcctaggtaatgctcaccaactgatgtcctgccatgagtagttttgccaagttccacaaaaaaaacttagtgttctatcagcatctaatgagaattacagtcattagttaaataaaagaactattagataaggagcagaatgaacaacacacaatccatcagcttggtgaatggtatcagatggtttctgggtgctgggcagctgtgcatccaagtagacagggagaatatatatgtcctttgccttatgtacttgtttctctaatccaaaggcacagcaatccgtggaagctgctatgataaggtgtttagtggtgaaaatgtcttgaaagccagtagattattaaagtgatgtttttaaaaatgcagatggagagtaagtactttttatctagagtagtagttctcaaagggaggtcccgggatcagcagcgttagcatcacttgggaacttagacctgcatgggccccattccagatctcacttgaaaactctagggggtgtagcccggcagtctttgttgtgaccagctctccagggggttctgacactccaaatgttcaagtttcagaacgctactcacaggccatcatgctcggcatcacctgaaagcttgttagaactagaaagtcttggccccaccccaagcctactaaatcagagtttttgggagtagggccaagaaaactgtgggttaacaaggtctccaagtgattcttattcatgtcaaaatttgaaaagcgtcgatcgaactgttggttctcagctttgattgcgtatctgaatcacctggggagacagttgagctattccgggcccagatcacatctagaccaattgaatcagaatctatggaggcaggacccagacatcagtattttaaaatatttcttgaatgatcccagagtgtagctaaggttgagaaacactgttctaggattaaaggattaatgtgtttgagagtatgttaagatcttaggcaaatcacaagggtgttaagaactaccatcttcgcaaaaggagaatgtgcctcagatattctggtactgctttgattttaccttcagtagtcttacctattttgagtatgcttagtagtactaatatgaggcttattactaatatgttaaaatttgtcttttaattaagtgggtctaaacgttttaatctttaatctctgacccaactagaacttttctaaacattttcataatagtctccaccttgtcttctgaccttcacttatgttctttcagggttcttcgtgtgttactagtaatagtaatggcaagtgtttattgaacacttactatgtgaagattctaactggcttttaataatcacatcagctctgggaggtagaaggtagggatcctccttgcttatcaggtgagaaaactgtactatagagaagttagcaacttttcccaggtcataatatgtgacagctaaagggagcataatggttggaataaaataaatctactctagttgtaccgaaggctcatatttgtctcacgtacttgatttggtcgaggcccaaggggtcaatttccaatgcttggattcctggatatgtagagttgtattaaaaatgctaaaaacctattatgtatcatacaatcatacatatcacctaaagtattatggaaatgaatctgtattattaagggaaaaaggcctgtgtgaagaacaactgaaacttcattttaattgaaattaaataacatgcatcatacactaaaagtgcacgttatgaccccatgaattacttcaggtggctttgattcatgttacatacactaacaaatatagaagagtgatataatgcttcttaattaactactaatggaagtttactatttaactgcttcttatgtaagaatgtaaatgttttctgaaatatcagaacttttcattaggaagcacttttaaaaatagcaaaactgatatgcactatgatttccatatacattaaattgaacttgtaaatgatgttataaattatagaaaccaaggggatgttcaaattagatatttgtctaaataaatcatgtatggattgaacaaatactcattgagaaataaatgtattccttttctttcaattatctaggattccttgtttatctcttcagaagcaaaatgtcttctgtccgttttatttccagttaaacattcttcagattatgtaaataagttaacttccaatcctcttatttctgtttatctcaccactcttctaatttagacgtgatcaatatcttatctttttgcatttcatagacatcaggatccagaataattgagtgagctcaaaacaacaatggcaagaatgatgttttcagaaaactcagcaatcattcgtttaataaatattcattgcctaccaactataagcaaagtattggctaggccatgtggggtatacaaaaatgtattaaatatggctcattctccctaagaacttacacctattagacaaagtacatgcataaaaattataatgtataatagaaaataaatacaagccctagaatgcacagttgaagtacgatttgcatttattataaaaagaaagatgaattggctgggcacggtggctcacgcctgtaatcccagcactttgggaggccaaggtgggcagatcacgaggtcaggagttcgagaccatcctggccaacatggtgaaactctatctctactaaatatacaaaaattagccgggtttggtggtatgcacctgtaatcccagctacttagcaggctgaggcaggagaattgtttgaacctgggaggtggaggttgcagtgagccaagatctggccattgcactccagcctgggcaacagcaagattccatctcaaaaaaaaaaaaaggaaagaaaagaaaagattaatttcctgttagctaaatcaaggaaggcttcatggagaaaaaaatatttcaacacacacttgacgtagcagtgggatcaggctgatgttagggaagaatgaatgacattctacactgagaaagagatattcagtatatatatgaagagcagtagagaaactaacaagtggaaatagactcaatttacaatacttgcctgcctggagtactctatacgttgactgtaagttgcagtttactcagaacaatcccactttctacttgtttatcctatgtaatcatttattgggcctccttttgctctcaaaaatatccttgtttggataatagattatcactctgttcctaaatgaactgccctgtgtcctatcccagtaaaagggtgcattcgggcccttcgtaactgcctccactacatggttgattgaaaccagagcttggcattaagaagttagctgaacaatcagatttctattcttggaaaacccaagaatttcagaatagatacagaagctgtatagctttaataacatgacagagttgtagccttgaaagctatgtacaattcagaattatgagggagaagaaattgaagaaacagtagcagccgggtaaatgcagaaacaaatgagggagacacctagggggtgactgaggcacaataatggaagagaagtgcagtgaaattgcttgaactcttactgatgagatttctactgttgccttgaatccaggaccacctatatgttcattctttgtcatgctcagagttatgacagatgctgttattgaattccccagagactcccttatcgtctcacctcaaaccttacaataatcccttctatctttctatccatccaagctggcttaagtaaagtctatgatccatattcctagtaaacagagaagggaaagagactgaaggcaaaggccccaattagtaggctattgcaatatttcagggaaaaggcaatggccatcacattgttgtcccaggaatgagaatagaaatgaaagaagataatgaaagttgaaaggactgggggggcttgacaactgtttagacttgaggagtcagataaaataggaagccaaagataattcagaatattttgattttgattttcatcaccaaataagatagtagtactatgaagaaaaaatggttaaaaaacaataataataaagagaactcctccaaatagtaccaagggagggagtttaatagaggaaattaattccgtaggtgatgagagtcctgagaagccaaacgagaaaagatcaaaacaacccagggattggcagtcgcaggaagctgttctcacttatggctggggctttaagcacaaggtgacatgagatttcagaatttgaagtcgtctggaggcagctaggatcaggtggggcctgtcctgttcggcaggacctgcaaccacaggaggaggatgcgtcaagcagaaagttggaacacaagaggggattcagccataagccacaaaataccttccagagcagagagaaggagaaataccctgaattccgtattttccctgccatttagttccctgctattgccacacattgacgtattccatccagagaagtccattggcatatgagtctgggaaatgtagttcccagggggacatgatcttaagggaaatagacaatgactggtgcaacaactgacctgtgtgaggcaggagggaaaaaacaggaataatatagtttttctctagatcccttcatgcacaaagatgcaaaagaaatgtgttggcttaatgagccattctgggtggccctgtaggtggctgtcctacgaataagatttttagacaaaacagagatgacttcaaatgtcacaagaaaagtatcagacaggaattaatattgacttgatctgtcacaggcgtcaatgatttgcattaagccaacgatcttcattgttaatgtctgggaaattgccagcagcattacgactacttgtgtggattagtgtaacggattcccccactaacattcaggaaatcatgtcaagcacagagtgcctatgtaagagtggttgtgtctattcactacatttcttggactaataacacacttagccttcctgaattgccaacatgtacaaaaccagattggggttttttagttgttcatggaactatcatttattgggtagctcctgtagaagcaagatacagaaactctaattaggaataagacagtccctgtacttcaaagagctctcaggggaggcacacaagtaaacaagcaattattatcatacgttaggataataccgtcatggtgataaccactgagtgatagccaaacacatggaagaggtacccaagtctaacttggggtagtcagagactgctttcaaggatatccgagtaagtgttagctaagacatgatacgtatttctaggagggaaattttcaaggcaaggtggagattgtgcagtgacgcccagagcctggattattttggtgactgctagtatttcagaatgacttcagcaaaagttgtagagaagatagaagacaacaaagtataagcagaggccagataatgaggacctggaacagtggtttgctggtaaatgtttaacaagaggctcttggcggggagagagagtgtctgatttgcagcatttggcaaattttgttgcacaaatgctccagcatagccaatttcaagctaccagtgtgacgtcattgaatgcagaattggaaagaaacgggcagtagcacagcattgtatagttattttcattacccagatataatagataaaatatccagatggtatttaatagatatggatgcaaaatttaaatatatgtacattcatgtgcttcatgttactgaatgcgcacaacattcattatccattcattcacgtgttaatttaacaaacatttctgagcctctgctctgtgccaaacgcagttctagctgctggaattacagcactgaaaaaaaaaatttgtcctcactgaggtaagacaaacattattatgcccattttacagctgagaaattaagacatatgaggattaagcagtatagttaaaatcacacaattggtacatgaaggaatcaaagaggaaatcagctctcagattttaaatccagggactcgtttctgctataccatactacctacctagttgagctggattttatcatggtttccctatttttatcaccatgtggttggataagtaaaataaatatatgtgacctttcaaataaatttgggtcatttttcttggaagctcatctggtgtgaactttaaaatactgcaattaataatgattataataccctggaactctgtagcaacctcttttgaagaactccaaggagcctctaaatgtatcaaactaagttcttcaagtgaattagttatcatctgagagtaatatagacttttaaaaatgcattaattgtattaaccctttcaggcccatagacttaagtgtttctttctccaaataaaaatagtaatctctgtccattttctttagagaataatgaagtaattttcattgaatatgtagtcaacataattacttcaattcaatcgtgaaggattttaaaaattatttatgtctactaacttaaagacatgcatagatttcaagaacttaaaaatgcatattgcctctttgccctatgcctcataaaacaaaattatgataacgttgtgtgttacagaaaaacgcactgattgtaatgaagggtgcttcaaaggccatgaacttggaaagcaacttatttacagagacccccagcaatagcagctaaaagattgactgactccctttattttcagttatccttcagacacttttgacctcttcctgtgcctttctagtcatgtgcaatcttgtggatatctcttccttcctcttgttattttctatttcctctgtttctatttgtttctaaaaataatcatgtttgaatataggattagcttccttcccatctccccattaccaatctctcactataccgctatgttattaatcttcctgagaaatatatcaggttcattacattagttaccagctcaaaacgtatcagtggctttctagtcctcacaggctcaagttaatctgcatattctgactttcatattctgggttcatgcaaacttttcaactttccctcttatacctacttaggaggaccctcaggttccatcatgctcatgtttcaagccagaagttctcctgcctcttcctctatgtagactccacatagactatgatatcctgcttctcttttaatcctccatcttcagctcacagccacactcctctgtgaacagttaaatgattctcccacctcttacctcctatagcacttatttttcatgcagcatttttgagacttaattaaatctacagttttaaaaaatgtttttctaccacagtctcttattcatactaaaactttcaagtctatccattttgcttatacaaccacaccgttaggtcttttaggtccaagaatacaagagaatggcaaagcacgttgtttacatccacacatactgtgtaaattcaggtaattttttttaatcctatgatcctcaattacctcacctgtaaaataggtactactcatactgcagaactcttgttggaattaaataaatgagtgtattaaaaatgctcaacaagatttggcacaaaatcggtactcagtaaatgctaatcattattccctttctcttcaaagctccacaattctgtattcatatcaccctctttatatcatttgcaaaaatgtatcctattccaactctttccacctagcctcaacatttacaaacactcctggtgggaagggaaagcttttgaggagagcacatctatactcatttacttctcagggatgcaagctgccctgcttactgagggcatatgttcatagtcacaccggagcccactgtccccttatactctcaaatgggcagtagcaaatcatcttgatcggtagtaatgacctgtctctaaattttcacatgcatcagataatttcttttttagtaagtgttatcttacatatatgccaaaatatcaccattatatggaacactagctgaaagaaaaattattcagtagtcttaattttctagctaacataaattctctccattttcatcatccatttagattaaagactttactgttagctgaatattcagagactttattctgatttttaaaatttatgaggttcataatgttaagacttcaagggtgagctgtttgtgtcatttataatgcgtgactagacagtaactagaaaatggattgttgactttacaagatttctccccaccacgtccccccaaacctgtgctgctgtgtatttggcctgaaatctttacttctagtcaatctttggacctaaagcctaccagcttttagcatcctttaagattgacgtgtctctgggagaccaatagatgctaaaccaaatttcgtatgcacttggcaatataggataataacaaccatactccctgcaattgtttcctaacacagatgtaacaaattaccacaagctgggtggcttaatagacatttattctctcacaaatctggaagctaggtgtccaaaatcaaggtcaattatccctctgaaggctctggggaagaattcttccttgcctcttccagcttctggtagccccaggtgttccttgatttcaagcagcacaagttcaacatctgctcctgacctcacataaccctcttctttgtgtgtctttctgtgtccactcttttctttattattattattattattattattattattattatactttaagttttagggtacatgtgcacaatgtgcaggttagttacatatgtatgcatgtgccatgctggtgtgctgcacccattagctcatcatttagcattaggtatatctcctaatgctatccctccccccctccccccaccccacaacagtccccagagtgtgatgttcccattcctgtgtccatgtgttctcattgttcaattcccacctgtgagtgagagtatgcagtgtttggttttttgttcttgcgatagtttactgagaatgatgatttccaatttcatccatgtctctacaaagaacatgaactcatcatttttttatggctgcatagtattccatggtgtatatgtgccacattttcttaatccagtctatcattgttggacatttgggttggttccaagtctttgctattgtgaatagtgccgcaaaaggacaccagtctttggatttagagcccaccctaaattcatggtgatgtcattttgaaattcttaactaattacatcttcaaagaccctatttccaaatctggtgacattcaaggtttcagggacatgtgactattcaggggaaactattcatcccaccacatcccccttgaaaattctggaaaatgtagtaataaaggcttctgataaattagtgtggaaagtattcacggttataaattactaaaaagtctcactgtgagctcttaatcaaaaggccctataaaacatttatttgcttgattaaaactacacatccgatattttggttttggatttattattatttttagacttggaataactattttatgtgaaatagattccataactgaagcagcatacctctcaatttcccaacatttattttattattttttgtcttcacactacttaataactgaggaaaaatcatttagaccaaagttcaccttggttgacaccatccagacagctacaggaaataacaatggaaactaaatctctaagaaaaagagtctttcatgtgaaatattgcagagttgattctagatatatagctgttggaagaatggatactattacatagatatggcagagtggtatccagcacctttcaacaaagatctttcagagtcagtcttattatgtctggagaatttacccagggcttaggtgcttttactgacaatctaaccacctgcaccccacccaccgtctaaagctaaagtttattggaagacttaggaaatcagtcttcggaatgtttctgagactggtacacccaccacttcattaaagtgcttcacttcacttcattagacaagaagtaaaatacttgtcaggaaattatttatagtaccatgtatatgggtatcttatttaatactacttaatgatggtactacaagttatataaaatggagaaataagtcatcaagtttgacaataatgatatttgatattatcattatcttttttattcgttcccacagaagtactctgttattggtttagaaaaatgatatttgatataataaagaaggaaaaggtggtaatattctttattttttgtatctttataccccagctctttcaccaatctcccccatctctgtagttctcctctggtgtccccaggcagtgaactattcccagtggttagggaacatctcattgagtaagttacatcaacatttcttcacatttcaggacaacaggaacagtgccaaatcctagcccattgttcaactctcaagccttattatcctaataacacatccatcccaagaaagaattcatcaagatcagagaggaatacgtataattttttatagtacagtatttaaaatgaaacagcttttggcccgcgtggtctcagtgggctcaagggggaaattcaggatgctagctcatctcacaccaagtttaataaagggtgtcctataaaaagctaatttcttgctggtaaattgctttttaagtaatccttgctgttgcaagagacccattcatagcgctgacactgggagccatgttggaaaggctagatatgctctgggagataaggtaagatccaggtggaatcttctctttacagaatgacaatgtatatagctaatattgtcctttgaggctagtttgcatgcagttgctggtatggcactgctcagcagcctgctgcagataagaatgagtgatgatgccctagattttaatggaacttttagagtgcatgcagcagtggggtgcagtcttcagcaaagaaaaacgagctgacttgcaggcatgagagatcatcaagaaagataaagaaataggacatccactctaggttaggcaaggctttttagaggatattatggaaatgagcaagaaccaatttaatttttataatgccactccatttaactttaaaatacaaggtcaaggtactgtgtttttcataatgattaaagatttggagcactctttctgttgaaacatactgcatctgtttggcagaaaaaaaaagtgacaaagaataaaactgggatcagagaacaacaaaaacatattctgtcacttgcctaacacaagttaaaaagcaaaggaaaaagagacaactctgatggacatgttcatccttatcccaacagaaggatttatttacctaaggtcctattatttcaagttactttgatcccaggatggtaacataaaatgtacattttaaaataaaatggaagtataagatcaataaaaaccacatatctgtggataaaacagcagattcaatcttgtggctgaaagtttgctttaacccaacatttggtaaactattcactctgtaatttattaaaagacatactgttattataaaactatctcagtttgcatcttgttggttctgtcaaaatttcatcctgctaattctcaacttgtaatatctctgatatacatgattaatctattttaggaataaaacaaaaactacctttatcttacgcatttctaggaagtgtttttagatgtaaagtaggggtaattgtagtatagtggaaaggattttgaacttgaagccagaacatatgtctctgccaaaaactaggtgtgtgaccttaaataagttacttagcttcctgaatcttagtttgtttagcttttttctataaagtggcacacctatccacatcacagttttgttgtcaaaattaaataaaatactatattagaaagaaacttttagaaagaaatttataaactgaaatgtactatacaagtttaaatcattctcattattttcttaccctaaaattttgaccttatttttcttagcaaatggctgaatctgtaaaatttaacccccacgcagcatctggattcaagagaactacggtcatttctttatacagaatactaattatacacatatagcaaaacacaagttttttccaactactctgtgtttttaaagattcagtgtgggcagaaggaattttatcaactatgttaggggaaaaaagtctgaagaaatgaaaataatgagaaaaagcactgttgatttaagtgcaggaacataaaacttcaaggcaaatgtgaggccaactgagttcatatatatcctcacaaaatgatttagttaatttaaaaacttttctaataagcaacacaggtaatcccaaattctatcttttatagctctaagagtccccataatttattcagcaattatttaccacccacttattataagaaaagccctgggataagtcttgagaagaaactaacaaaaacaaaacttgattgtttgctctcaaaaagctgggtctaaaataggcaaggtaagattttgttttgaggagcccgtattttccagcactgtccattgtaacattaaaatagtttgccaaaatcctcactctgtgggtgtatttgcctagggtgctaaaattgcttaaaaactttgttatttggctaactaaaatcactgaatagtaaacagtagcattagagatggcagagacattaggtgtcatgcagttcaactgcttcacctagcagacaaagacattaagttccatttcttaaatttaactatctggttgaggatacacagtagcagagctaaatcaagaacctcttggggttagagtttttgtttatgcattactttgttttggaattaaaaacagtgcctgtttgctaagttaaattgaaaatatgctctgaaggagaaaaacagctataaaaatagacttaacttccaaactatggatcacaataaactaaagaaataatttctgtagcaataaactccaacactttccataggaccagaaaggcttgagaaagaggagaacaaaaaaatgctttggggcttaccatatatatggagaaagctaaatgaataaaccagttgaaagacagcgagttatactagtaacaatattactgatatcggagctctcacttataaattgtatattatgatcatagtgactaggtactttatatctgctttctcattccttcctcacattaattcacatgtaggacagattacctcttctgtttctatccagaggcctagagctcaggccctcatcgaagacagacagagctatcatccttattctaaaaaaaaactaagaccccagacatagctgtgctacttatagactagaatgtgagagaaaaagacaagctttcatcatgggcttaacaaactgaaacacttcttcaattttgagattgagaaacttagctaatgctaggtgtaaagatgatatgctaccttcataaccttggtgaggagaaattagcatttctctcagtcctagaaggaggatgaccatgaaggtcttcattctcttgagaagataatcaaatgcttcactgccctgttaacggtttactcaatattcaccaagaaaagtagatgggattatttttgcagacacttatacgggtaatttattctgataagcagagacatacctttagtgcataaattgttccctttgtgctctttgtaataaacatcaccatagagaacaaacacgaagtaatgacattgaattaaaagacaccatagaggcaacagcgactggaatttgtgaaagtaaaaggatagtgcaaacagttgtgcgttgcattctgctctgaagattaacaagctgggtcaggctttgaccatcatgatgagcaggagatttttctaatggaaatccccaatcaagttcctgctgcacccagaaaggaacggcttacagaaatcttacatttctttgcacataccaaattgcttggcatattctatcacaaggtttactttccagggaatgtgatcaagaaatcatgatcctaattcctagttaaccctcaaagtttctcagaacagtcagtgcatcactgtcaacttttgtgcaatgtggaaatcagaattggtcacacgtttttccggccactgttttagattcatataatattagtgaaatcatgtcagactggtatagccatgaatttatacttcatgaataggcactcaataaatagtggattaaatcgaccgatttgatttttacctccaataatttcaaaaatatcattgaagacaaggttgttgaagctgtcacttttcttgctgaacctttgttgtgccaggaggaacagatggtaaaatcaaaagtgattagagaatcagtggggtgggggtgagattggaggggagaggtcttcccagtgagacccgctagcgtcttccctgagcagtatgttaacccaagacaattttagaaatctgtgcccctaagttgcttgacatccaaagcacacttgatgcatcctacatttctaaatatttttattgttgtttctcggtagtaatcatctggtttagtcactctaaaagtcaaggatgaaattttaaaatgcaaataaaagtgcctactttctctctttccaattcctttttgttttattgaggtataatttacatgcacaaaaaaatcgcctttttaaagtgtacagtttgatgagttttgacaaacatatgcagtcctacaaccacgtccgtgatcagaataggaaatatttttatcacttcaaaaagtttccttgtactcccgttgcagtcagtctcctgccccaccccagcccctggaaaccactgataggtaaaagcacttttaatctgaaaggtatttaatgtatggcagtgtcagtggtaataataacaagatttattcattggttcactgtatttttgagcacttatatgtgcccgttgtatgcaacccattatgctcaacccctgccctcctcaccagggataaactagtggcagagatagacaaagaagccgtctctctatcacccctatcttatagaacattcttcaatgttagaaatgcagtataatgtggccattgagaacttgaaatgtgcttagtgggaatgaagaactgaagttttaactttatttaatttcaattaatttaaatttatatagccacatgtggctaatgactatcccactggaaagtacagcttctatacaatatgataatatgatacattataacgcaggagtttaaccaagtgctaaagctttactatcaccagggtcactggtgttatgtgaaaagaaaacttacaatagaaaaataaatcctttaaatagtcacagacctgagaaagtttccttctcaagggaacacacattggctcattcaaaggaggttaaaaactagcatttaaggtaatttcatgaagctttcctttggatttctcatgcttattgtatacataaataggcaattttcgatgggacctaataaatcactgttttttatttgaacattttaacaaaattatcaaacagcattgcatttatgttcaacctatttgttctgagaaagacaacgattaagtagaagtcatcaaagttaccagaacaatttttgttcttatgttttagaaggcattgaaggtgtttaaaatgtacacttatagagtcagagtactatgcaactgtggcccttatagtttatccgtcatgcatctaaagccattgttacatctgtttctaattgtgcatggattgtccaagatacacaattggaaattccattttatttatcaatttgaagaggtttcacccatgtggtcactatgatcactatggagtcacattaaattgagaagtctccagaagttgcagtatttatttaaaattctaactttcttcagaggaacaaattctccatttctggattctgaatcctcattagccataaggttgttgtaagaatttgcagctaataggaacacatcctggggagagaccagttgaaaagtaacttggttctgagtgaaattatacagagacagtttctacttcaggtggtgttgctaatgaagctatcatggtaattttagcccatatgatccctaaacgacttcagaaccacttttcatccactaagaacccacttcaaccactgccacgttcactaccacagtataatatggaacaccctctggaattcagtaagtaacttcttaactcattggctatagagctttgcctttgtaaattctttccttttgcagtaaaagagattgtttcaaagtaatccaattagtccctaggcatgtctagaaaggtagagtcaacaacagtaaggtaatagtccttataagatatgtaagaaattatcagtcatttactttaaaataatttgtacacttttccttttatatggttcttctatgttgaagccagtggtcatccagtgattaagattagccaaactcaaaaggctaaaactaaattcaaatggtattattttgctttaattttatgcaatgctatgtatttaaatttcatgaaagtttcgtatggcattgctatcaatttcagtcaggataaatttcccgtgaaataatccacaattttcaactgtacgttgggtacaggtaaggaaacacccttaagagcttatccagttattagctggtattataaatttcaagtaattcaatgttcaattaataaacagttactttaaatgggaaagtatgagtcaagagttagtacaaaggagaatcttaaaagatgaacatcaaagaatcttactattgatttgttggtgcctttgcttgcacttctccaaattgacttgacgttttaaatttgtactgataatcatcagagtcaaatctgcttttaggcaaaaagtatccgctagttattcccctactatgaaagtgatgagatgaattgatcatgtctccagtgtatggatggatgtctttgaggaagacctactgaccttatgtttatcttctgtcagcatggtgtgactatgtggagagacagtgctatttgctaaatactttgtttttcaaataaaaagatttcacagattatgcattgtagaatttataagtattcttttatgtctttgaatgtgccaatacaatttttatgaagttggaactattttatctattttaatgaaattgtaagccttctgtgaattcttttattaattttattctgaagaaaatctgaccaggttagggaaatcaggtcaggttacgacgtgatcccagtggaaaagctgaactgtggactgtgatttaaaatagggaagaggtactgaagtgttgtttttatttttgtttacaaatcagcctttctaactattatgtactcccatccttctatctttttctccaccagaacgtattaacaggcatgcatataattaatgcttttcttgagataatattaaaattaacttcatctgtcaggccgtctgggctaaaagtacacagtcagatctgggtaacatttgagttgatgtaaatatgcccacacatactgacaatgcttaccatttattgtgtgaatgaaaagcagtgtaaatattgtttgttctactagggaagctccacattttaatcaaactttgaccgtatttctaaaatgccagagcatctggaattgttaaaggaactgatagtttttgtgtttttaactgttaggatacttgaaatccaaagggtaaagaaactcagctgatttatacgtttcttcctctttattttaatgtgataaaatgtagtttttgtcatgggctgacaaacagtggtagactacactaactctgcgtttgctgggtttaatcttaccctctcaaggcatggaatgggagctcacttcagacccagccatgcttcactgtccactgccttctcatggatatagtgtgaacattaattagatgaattccataaagtgctttaagctctttggagaaagatactcgctgcataattattcttaactcccatacgctcttatgatataaaccattctgccaggaaatcctttttagggattatcacttaaaatgaaattttcattattaaaagcaggaagaatatacatctactgacagacgaaaatgtgcttaaggcgactgcttttaaataggcagaaatcctgaactatggagccatccatgcctgaaaatactgagtaataatgaaaactggtagcaaatttggaatattaatcatcacattaagttgcaaagaaaaaaaaatacaagccacatgccctttaaaaatacgtgcacaaatctttattctagaaatatataactttaggcctaaaaaagtacaaaaagtaaattattttatggctctgaaagtatccttaatttactcaggtgacaacaattagtgtttaaagagttagttttcaatcttagctacaagttggaattactctggaagctctaaaaaaacaaaaaacaaaaaaaaatagagatgcctagttcccacctgcagaaattctgatttgatttttctggtgcgagacctgagaataggaatttttttaaagcttccctagtgattctagtgtgccacctaggttgccttaaggtaaacctcatattatgcagaacctagcaatcacctatcctgattttatagacgaagatcataagacccaagagggcaaattgatttattcaagattgaatatacaaatgatagaagattcacataagatgcagtatacagagtggcttgtggattcttgccaatgcaggcagcagaattttctttagggttcacccagttcaggcacctctttgcagcagcacttgactaaggttcttctgattggatcattatatgggcaaaaagaaaaagcttaattgaaaagagctgaacccacattgtggaatggaagatatacagtttacacgttataaatgattaatattcatgaaagcatactgccctttcctcttcccttcccatagatgacatcattgcattggtgtagttaggttggtggtttcttgttgttgatcttggttctgacacagttcatcacttattatcctggcttattatctacttctacattcattgttcactcactcactaattaattcaacatggtttttattgttttggaccggttatatgcctgcaacgctacgtaaggctgaggatattacaatgaacaggaaacaaccctgaagtttaaggtatcaagcctttgagttactgtcttttatcatagctgatataaaattgaagccccactttttttgttttcaattactgaaaattcagtgctaaaaaaatgtggatttttattcaactagataaagtactacaattaggtttccactgaccttggctgtttttgttcccagttgccattacataaatctgtgccactcacaacttaggaagggtgtaacattctctgtaatagtttgcctttcgaatagtgtttggattcattactgtccctcgcagtttggaataatgaccactgaataatcagtgtttggagactaaattagtgctgcaaaattccctcaaattacctactgttcttttccctgtcgatgtatcctcatattcactatgattaccctgagaagaaagatattgttgagaaccactttacctactcgaagttttggtatttcaaagattcatacttatgtcatgttgattacattagcactaatactattggcagaattctaattcacgttattttctttttttccaatttctctccatgcctatgtgttgtcccttcgcagctataaagccatggccgattcatgggtgcttttgttaaggcgttcagcagtcacgtttgtagatttttgaatgggacttagagcccttttttgttctttatgtatttctctatttctcagcaaaggaaatgcagacatgcaagaaatagtgatcaaatgtcctgtgtactattgtgggtgtcattaatggtatagggagaaatagaaaatagttgcaaagatgcatttaacaaataaacgaggtcttgagattcaccatgaatgtggccccttctatgaaaagtagttaacatccaactgcaaagttgtactggatcagtttgactttaacctttagctaatatgaaaatatggaattgtgtggtggtgctcacaaaaaagaaaactcatttttcttaattatcatcaattaacatgtactgactacccatgagggaaagttaatttgctcttgagtggaaccagttatttgccctattatttctcccttgcttattcccctctccctccctcctccctttccattcaacaaagaaaaatagataaagcaatttctgattagccagtgaaagcctctaacataaaatttccaaagatgtgccataaattatccacaaaatgtaaaacttttcaattttggtttgcattttcttttttcttattataaaggtaataagtgctcattatagaatttgaaaaatataggaagttgcacggaagacgaataaaatcagccataatcctacaaacctattgacacttgtacatatgtttgttatctctaatgcattcattatgataatgcatcttttcaaccaatagagtaatcactggtgactttcaaatttgcctactcatttttcactctgtggacttactttactacctcttgccctttttcagtaaatgaataaatatttaagtaagtaaatacaaatgtaataacttatgcgctcaagcacacagatacacacagagagaatttggaacttcggaaatgccatcctctccctagggccgcaagtgagttgataagcacgtaaggaaggataatcaggggagccttctcgtattgcccagatggctcaaaattcgtcatctctaccaaacaactatttggagctttgaagaaatatccatgacccctttgaattcttcagtttctttcgcgttcactttgagaaccaagtgacaagtgaatttcctgacttggtcttttaaacctgttagcgcagttccattgagattttgtgggcacaagattgcaatgaagagatcaacagggagaaattcatttccctatatatgtgcgattaatccggagtgctaagggcagatataaagcaggtgcctactcctgtataacttggaataaaaccatttccaaaggctgatgatcctcaagtcttgttctgcaaatgactgatgtataacttcaggccaatttttctccagttagtctgtgtcactgggagtcccatttctcggggagcagccccatgctttgtcaggtgcggagcccacagaaggttaatgcgaaaagaaggcctcttgccagactgttttccagatgatacgtagggttattagtttgagctccttaagaagatttttctcacctgtcctaccaacttatgtttatttcattggtgttagagggtttcagtggcggaagtaaaatatttagcggggaagggacagcgttcatgggaattttgcctaacttaattttgtatctttagctcattcgtagtcattgtactttgtgttttgtcaactgaattttgtttgcatacaaaggcacaaaatgtttgcttcagacctgtcactcttatttttagcatggttagacaaaaactgagatgctttaattgtctaacttatcccagtttaagtgctgcaaaatctcccaggcaatgtcatgggcaactaagggataaaatcagagatttaaaggtgccaggtttcccacgcttctaacagttggcgttttgggtgtatacaatccctcagctttcttctttagtttatggagtcttgtggagggaatagcaggtttttagctaaaattatcatgctgtcgagttgggtctctagtgcatcctgaagagcttgcattatttacagaggctgggctatcattttaaatcctgatgcttcaatgcccgttatcattcttgacaaactcttccagcccgtggtctgttttcctctgtttgcttccatttactttcctgagcaaccagctgagcaaagatttacataacttttgtttaaacaaaccctgtacagttcactctttcagccagtatgtaaacacttttgagacacagttacatttttctattttagtcccagattctgtttatttgctacattttttgtgcccacatttttgtctttgttaagtctcttacagattcacatgaaaaaccagaaaccgtggctgctcaaaagtcattaataatgagatttttagctactgtttctgcttgtaaattcttcatttcacataatacagtctcaaaaggccacagagaattcagcctcgcttatctctgtgttgcagatgatggcttctagccttacccaatcccagtgcagcttgcttgccatccaggagtcgaatttgtttccatctgacattagcgtattaaaaagattggagatcaacaagcaacaatgttcttgtagaaaggtaatcaaggtttagagcctgtgtgtcatgagactcctagcatttgaaaccgctaaggggttgaccaccattgtcccaagcacctgtttaagattctttcctatgataagggacctaaagtgattagcatactgataagattttcctagaataacctatttatttcagtattattctttcaaatcttaattaccatcttttcctttacccagggtcttctttctacctctacgacacatttaattacctatattccccaacctgtaccatattaaattttgaatggaagttttatagggtaatttattggaaggatggccttgagtgtcattatgttcaatgaatgccctattttgacaaagagatgactaaatgttattgaaatctttttaatccaccacgcttctgcttagatgtaaatgcaaatctgttctttacatttgtgattgaattgaacttgaaaagtaccgccatattgattccttctgcaaataaaatataattacatttccctaaactttctacactctcccaagagattggctggctttgtattgtagatttttggtgatcacagaggacaatgcattatcataagaccaataagatttatttttaccttggtaaagaattttaatttatttctagtttcattttcatttatatccatctcttctcaccctctgctctacaaaagtatatatgactatataaattgaaaaaaatatcaagtgcaaaattacagaaataaataattaggttattttagtggaggaaggtttgttgtgggtggaggaggagaggagtgagccaagaaaaacgagggaccatacgtgatcatatttttgcagctattttaaattgtttgtgtatatactttaaaatattataaaataaaattttaagtgcaatgcatatttggagccaatgatgagggataacttcagaaacgtagcatcatcatctagtgctttcatagtcctttcaacatttccagatagttttaatggcctgctcatggaggcaatgccctaattttaacatatctcttcacaactctgatttcttgcttcctaacattaaatgtcttcaaagcttctttcaccactaattccttatcaagaggataagccagtttattctttaagaaaaactagctacacaaaaccgtaagtcattccaacataaatccttcactatcctctctctatagatttggttttgattcctcctgctgaaattcaaccttctttcttcagctatccacacgtcttaccctctaacttccctcaggagtgtctattagctcccattacagtgaccacagtaatatagtaatcccctgctgttctcactctccacttccttacactgcgttttaagtctcttcatattctttatcaccttgtatcatgcatcggttttcttagttgtttattttatgttgccttcataaattccatgagagctcactgccgtatctttagaacatggaacagtgcttggaacataatgggcattccttaaatagctgtagaataaactttcaaaatcaacaataatgtatttgccaaatccattggcttctctgccattttatcttgttcaataccactgcgatattccccttcctttttttttttttttaaagtctgtaaccctttagcttctgtaatattcctagttttttattcctctcatgtgtcaaaatcatcagttgaggcttattgttttctctttctcactctgacctcacctttgtttacatctcatcttctggctttggctatcctgttttttatctctgttccaacctgtatttctagccctactacctggacatgacatgtggatatctccgtatgaccgcagtttccatatgactttgcaaattcatccctgctctcccctccaaagtcatccccacaattgacttcctgttccttccaacctattaaggttcaaacccacttttgctcctcctttgcaggctacacttttccttctcagtacctcttttttttccaagttcttagataaaagtcatagtaccttacgttgtaattgccactggtctggtctttctgcctgctttcctttccatttgtaatcacattatccattccaatccatttataatactgtgatcagccataaaaataacatttatcatatcgtttgtctccttaaaacctgtagtagatcccctctatttacaagatctggtataaaatcacccttcctgatattcaatgcctgttttaatataatctcaatattatgcgtcataaatccccctgtgttcttgcactttttatttcttatacatctcatcaaccatgtcttatcaactctcaaaacctgtattggttttcaggaaaactcataaattattcttttgtagaccttttgtttgtcatctttgaagatctctctctgaactacaatattttgtctgtataatcaatttggaaattcatcaggtattgaaatatgacatgtcttctattgtcttgaacattaattaaaactttatttgactttttatatgcttacatcttgtttcctcacggagtgttaacctactagaaagtaatagtttaatcttatatttattttaattcagatttagtagcatactttacacgtggtaggatgtgtaactgccttacaccttgcttacgtgagttattaatgttttcgtatatttaatctgaggatgtactagcaatgttaaaactgtaccgcatgaaattgagtaattgaactatttgttttaaatgtgttgcttaacttattgtaccattttctcataatcacagctcaagttaactttgtggttgtacgtattatttcttgtgaaatgccaacaaacttagagcaaggaaaataacaggtataatcatactataaaggcaaccttaacactagcatagtctcttagctcatatggtaactacaataatgtacagtgacaaagagaatattgtactttcttagcacacactttcctactactctactgttgtggataaaaacagacatactttaggagaaactatgttatttccaaataatgccttaaaggttactccaggaaaaggcatttacataaactatctaggaaaagaaccttttaaataatataaagagctcacccaaaaggactgaagtgtttagttgaaaaaaagtaaaaatgtcgaagactttgaaaaatagtttcttgcagtatattttcatcgcttccacttacgttatgaagacattaagcgctagtttatcaaaaactatttttgtacatgtcttctaatgacagaacaatgtcaacatgattttcatcattgagaatgcgtaaagaaaccctttgtacagttttttctatgaatgttcccctaagattaaagcaaatttccaacacgaattaggcactccgaaaggaggaggggagggaggggagcaagtgctgcaaaacttcctgttgggtactatgttcactatctgggtgatggaatcaacagaagcccaaacctcagcatcacgcagtatacccttgtaacaaaccaacacatgtacccctgagtctacattaaaaatagagattaaaaaaaggaaatcagtatataatctaataaatacctctcaagctttctcatttttaaaataaaattttagattattattttaggaataaaataggctcttcattgtatataagttcatttctgagttgcaaaaatcctctctttatgtttttttccccgtattagcatgtttttctcctgtttttccccactcaacttggctgccacaatcagaaagcacaaagacaattttttcttgcgcttgtaaatcaaaaccttagcatcagacaaaataactgctccaggtctgtcaaatagattcatttgagctttcttcatgcattgaatacggcagaatttctgacctgaagaaatctagccttttccaaatttgctttaagaacattttgcaataaatttaatataataaaaggaaaaaacacatcaggctagaatttggaaccgattgttattaaaaatctcaagtctatcaatttaacttcaacaaattacttaatttctgtgatggttaatttcatgtgtcaacttggctgggccgcagggtaccgagacatttggtcaaacattattctgggtgtgtttatgaggctgtttctggagagattcacatttgaatcagtagagggagcaaagccgattgttctcccttgtgtgggtgggtctgatccaatcaattgaggacctaagtccaatcgattgaagacctaatcaaaaagcctgattaaaaggaactcctgcctgatagctaaagctggaacacccatcttttcctgcctttgagcttgaattgaaaccttgggtcttcttgagtcttaagcctccagttctggggctggaacttaacgtcattggctttcttggttctcatgcctttggactcagacaggaactacatcattggctttcctgggtctccagcttgctgactgtaaatcttgggacttctccagattcgtaatgagccaatttattacaataagtctctccctctctggtttcgagagagagagagagagagacagagagagaaatgagagcacaagaacgtgagtgtgagagtgccctaatataatttctctaaatatcactggttactcttcaaagttataaaattggtataaaaggtgacctcaatttttcatggagttaatgtatgaaagtcacaattaaaaaggaagaattagttctggtgtcctgaaagttatttgaataaattaatatgctatggaggctttaaaatactatgaaaatttaatattgtattattcttagtgttgctatttttaaatagcactttttcttttcctttttttttttttttttttttttttttgagatggagtctcactctgttgcccaggctggagtgcagtggcatgatctcggctcactgcaagctccactgcccgggttcacgccattctcctgcctcagcctcccaagtagctgggactacaggcggccgccaccacgtccgggtaattttttgtatttttttagtagagacggagtttcaccgtgttagccaggttgttctcgatctcctgacctcatgatccacccaccttggcctcccaaagtgctgggattacaggcatgagccaccatgcccggcttaaatagcactttttcttgtgagtcactttttaaatatttgtgcaaaccttgttgccattctactcaagctaatatcctaaaccgaggacattataacatttcaggagtcaaaacttcagacacttaacatagtatcctcaggttcatccatgttgtcataaatgacaggattttattcttttatatgactcaataatatcccattgcatatatatgcaatattttctttattcatccattattaaacacttaagttgattctatatcttggctattgtgaataatgctgcaataaacatgggaatgcagatatctctatgacatactgattttatttgctttgtctctgtccccagtagtggaattgctgtatcgtatggtagttctatttttaagttttcgaggaacctccataccgtcctccataatggatgtactcatttacattcccaccaacagtgcataagggttcccttttctccatattcttgccaacactttttatcttttgtattttgataatagccattctaactggaatgagatgatatctcattgtggttttgatttgcattttcctgatagtgatgttgaacattttttcatatgttgtattaactaagccaaacacagaaagacaaatgcagcttgttctcattcatatgcacaatctaaaaacatcgatctcatagaagcagtaaatggacggtggtcaccaaagaatgggggaagtaggggaaaagcgagaatggggagaggattgtcaatgggtacaaagtcacgattagaaaggaagaattagttctggtgtcctgttgcatagtatggagactattgtcaacagtaaggtattgcgtatctcaaaacggctagaagagagggttttgaaggtttctaccccaaataaatggtaaatgtttgaggtgatatgctaattttcttgatttgatcaagtaaaggtcttaattgtttggcaattaagactcatgaatacaaataaaggtcttaattatttggcaaagcatgctgagttttgtaaacaattcagtagtgatttttgagaataggtcaatagcaaatattaattaaaatgtcttctatttatgacctacagctagatggtaaacagatagatgatagatagataactgatagataactaatagatgacagataaatgataaatagataaatatagataatcgagagagaatacctttcccttcacacacgtgcatataggcacactccatttctatcatagttaccaggattcagacattttgtctcactatttttctcaatgtgaacatgcatataggaatattatagtttttgttctgtgcccattttagttcgttttttaatatttcaggacaaaggcaatatggcggtttcactttgtttttcatttttgcttatactttttaaagctcagtgtagaaaagtttgaaaatacacaaaagtattaaattaagacagctgggcacagtggctcacgcctgtaatcccagcacttcgggaggccaaggtgggtggatcacgaggtcaagagatcgacaccatcctggccaacatggtgaatcccgtctctactaaaaatacaaaaattagctgagcatggtggtgtgtgcctgtagtcccagctactcgggaggctgaggcaggagaatcgcttgaacccgggaggcagaggttgcagtgagccgggatcacaccactgtattccagcctggtgacagagcgagactctgtctcagaaaaaaaacaaaacaaacaaacaaaaaagcacctatagtctttctcccataggttgccttcttaatgggttttacaccttttgatgttttcttgagttctgtcccattagcaagtagtattgtacaaaaaaaattttatcatcttttatttaatattttattgatgtttaataattagaattattttaaattttatatgtcattttaaaatgcaatacaatatagtaaactcccagatgtgattgtaaataattaattattctcccattattgggcattgggactgcttccacattttggtcactgcagtgaacatccttgtacatgaatctgtatgttgaagttgatttcattccacactccccttcattcaaggggctccaaccattctcgttttctttcagcttctttatatccaggcatataaagttccttcctgactcgggagcgtcatacatgctgttttctccatctggataagtagttaattctgttcttctttgtgcatctcccgtttcagtaacttcatctccaaagcctttccaggtcactttatctaaagttacaccataatcttgcaaatcctcaactattgagcattattagtctccgttatcattattctccattattctctgtgaaagcatcccgtgattttcttttgtccctattaccacaatatgtgtttattccgtgtatgtacatctttgtttgtttattgtttgtctatacctgcaatgaaatgcctaaggtcaggaactgtctgatgcaggatgcaatgcgctcaataaatatttactgaacaaattaattcatttgctcagtcttgcaggcaaatggtacttctgtatatttaaatatctaaaatgaaagcgttactcgttactgttggttgtcaatcaaaatttaaatgtcgatgtttaagcgtgaaagacctctgtcaagttaatctgtacttacccaaaggctattatgtagaagcgacataaatattttcctaaatgttgattttcatattttaagaagacaatgaatgtttcaaagcattttcttctacacagctatttattctggagagtggggcatatgtttcttaatattgttaaaattggcaaggggatactgttgctatatacaaagaacacctaatcatcatgcagacgttttgtttctggctctcagttatgaaaagcagagattttaaaaagttacctttatatgctaaattaggaatggcagaaggtaatattctaatgtttataagtggttcttctctgagtccttggtttctatgtttatgaattctctttttgaaagaaattatagttattattaccaggtctattcttttacattgtttctaattctatggtgatcttcaaaatagagtatcaattttaaatacttgggaatgaaattattcttcccatatcatttctttgtatggcatacattgtgatttgttgtcccatcattgtttcagtatgacctgttactgcaaaaacatattgagataaatcatcccacatactctcggccaggacagacatcacactgttgcagcaacacttcagatgagccccattcaaccttgtgtttttatagagaaggatgccacatgtttatattcatttctgaagattggctcatattatttattgaaacatactagtttaaaaatctgtccatttatataacacctggtctatctacataacttgaattacataaatataaaactaaacttcccctcttctccagtgtatagcttgcaagcaagtgcatgtgaaataaattaaagccttgtttgtgtttttttcatcatgtgagtacaagacttttcaataaaaatgaattacttttgaacatatttgtttggacaacaaacaagagaaaagatctatttgattgatagtggacagaattttcattaagttcaacagcagaaataccacaattgcatcattcaccttcgtgtatcaaaagaaaacagaaaattagatgtgatgaactctacacaaatgttcactatgcatactttacccattaaatacattatcaagaatcatgtcagcatgacattctaatatagcagctttacaaaaacatgtaatctaatctagggatgctgttgtcctctttaaatcagcttcaaacatattctgggttgatatttctcattcttttttgatccacattgtttattcacataatgattatatttaactgaagataacagcattatcaaagtgaaagacaaaatagatgtttaataggaaagtgagtatcgaatcatcttttttctaccaaaaacatctataattatgaagtatttggttaattattttcacaataatttaaaagtgtacaacttgccgatttttttgtactttctacttttcatgtctcgcatatatctctttaatatctaagtatttgagtcagaaaagagccagtaccgaataatgggaatctcactgaaatgtgataacaatctggggcctggtcctgggacctttatctgcaggacaacttggacaaatatttagacccccaattcctcgtctttaccctaggaataataacacatttttctgacctcatacttcacgtggatctcaaatggaacaatcatctgatagcactttatgaagtatatgaaagcaataaattatcacaataagataattgcaattattctttggcatagtattagtgatgtctttatctgtctgacaaaatcaacatttctgtatggtaactgcctttccttgttttaacagaagatcatgccagaaaagatgagtaggtagatacttaacttgttgttcctgaatctggaatgtattgcagatgtcccagactgatctttgttcttttttttccttacaaatttcttttcacattgacagtgtgatatttctttaaatgtgcaatacatagctaaccttatttgtttgtgtttactaattaaaatatctaaactgcttaaaggagaaaattcagttttaagttttattgatttatacccttcttcaatccacataggattagggtagtatgtaacaaaatttcaaactataaatgaaatattgagttttgtattaaggccaaggatgaggaaaaaaaaagtaagtatatatggaaaaagaatggtattgaatgggagttttgatggagcatgttgacatcatgataatacctattatctttatattctgaatgtcagaacaaaattagagcaattttcccttatttccctacaatacgtctgtcttaataattctaagctttcctgatttcagtagtaatctgtattttgcaaaaggcagcatgtttataagatatcaagtaaactaagtttatggaacttgtaacagcatttttaacaacatttctccctagatagttcatggtagacatgaatttattcaaaactagtatgtagaaaaataccattaacaaaagctctgaaattatattagaggagctgaataatgttacttgagaaagaataaaatgttatttatgatttttggtatcttttacccactatatatggccatatctctgaaaaactttagtaatatgtactaatgcaaatatggtagtaaattatgtctacaggtgctgataccatagtagataaagtatgataactttattttaaaatatcatatttaaataattaatatacagtactgggaaagactattttatctattctctcactcttgaataaaaaaatccagaaaaaaataccttgttttggtaagattatatcaatttatttcccaaatgggtagagggttatttttttctgatcataaacgtatgtctcttcattataaaaatccactaaaagtgatagaagaaaaccaaaagaataaatgtaaacaatgatgccattttccaaaaatcaccttcgacatttttctggatattgatacagtctaaatctcttttcggaagactccctcctgtgtaggttccccaactactctgcaatcttatttcctcttgttctgttcttgtagaaaggagacccattgtcaccatgtcaaataacacaaaatggtgcacgtataagatcattgtctctgtccattatttgccagaggacctcaaactttttcaggtggtgggcaactggatgtcatgctgctccttgtacaacagaacacaattcattatttatatggttatttcattttaagaaaatttaactttcattagctggaaaaaaaaagaagtggtttttaagttgtttagaaatgtgaaattcaattttcatactgcaaaagagattcaactgcaaacacaggcacacatgtctggtgtaagaacgagttgtcatacaaacccaaattagctgcctccacgttgtctttgttaacaagtgtttgtttgctccttgttccatcattcagaaatgctctttagcaggaattgatggaacacagtcgcagtgacctcttcctgtctttaaaaatcgagatgacatttgcccatctgcagtgttaacatagttcctcaaagaccactgacagtggggtaggactgtattgcgcaagttctctcatttccctagaatataattggtccagggccagagattttagctcatttagagcagcaaggtgctcttttaaaattccctcacctattttgggcttcatttcccttatacggttatgccttttccagtctgatgaacattctccttgacagagcagacaagcaaaaggagctgcacactgctgctttctgtgtcgtctctatccctaaccttctcccttctgccccaatcagtgaaccttcgtctttctggttcttcttcctccaaatggaagtaaaaaggccctgaatgttgtctttaccattatcacgagcctcaattcattccaagctcagcttttcctcactgtttatacagttctatattgttcttctaatatttgccctcagttctctgtccctcgtttcttcccatgttcatactctattagaatctgagcacctttgaggttgtccatacagtggcacacatctttgttttatactcactgggatgatttgccattatattgtcaaaattttattctaaagagcttttacaggctttcttgagccattttctcttgaaattcaagatcgttgaatctctacgctttttccttcttaatctaataaacatacacccccacatacacacgtgtgttcctgaaagacagatgccacttgactcgtcttatagattgtctaaattgatcattgtgtgtggggataaaagggtgaattgtataatatccctgatggttcacgaagtctgttcctgtataacctgattagtcttctgaactcttttaaattctgtctgcaaatgactgaggtttggcaatcagcctatttcagttagttgttttcttgcataagaagggtccatatgtactgtgtgaagtaagagagagaaagtacttagatttgctggatgccctgattgttagcatggctaaggtattgtgtaagtaaggagagcagttaaaaatgatattgtttttatttcttaattgaggtaaaattttatataagatgaaacagacttatttgggagaggaggaagagtttgttcttacataacatttcaacctgtcatatttagttgagaacttcaatctgtcaagatactttgtataatattcagattctgccatctaatatattttccacgctttcttactgggtgtgacagtaacttatactgtggcaggtgtataagttagtaaagatattaaatgctcaatctgttaacttttgtgaagtggtcccactgataaagtgacacctcaataaaataaaaatttccattacctcagaaagctttttcatgctaccttccagtcaattcccagccccaataggcacctattcttctgatttatatcaccatagattagttttgtctttttaaaaatttgtataaatgaaatcatacaaaatgtactattttgatcagcatactacttttgagattcatccatgtaagtgtatcagctgttcattcctttattgatgattaatattctattgtatagatataccacaatttatttatctattctccttttgatggacattcaggtggttttcagtttttggctgttatgaataagatgctgtggacatttgtgtacaagccatttgtgagcatatgttttcatttagtttgagtaactctgtagaagtggaatggctgggtgaaatgtttaaatttatgagatattgtcaaacagcacctaaacagttttctaaagtggttgtgccattttgcaatgccaccagtgatgatggagagttccagttactctacatctttgtcaatatttggtcttgtcagtcattttaatttttgctatcttacagaatatgtaggtatattgttgtggttttaacttatattcctctgattactagcactattaagcatcttttcatggatttattggacattcatatagattatgtgtgttgaagattattacctttatgattattgggtgaaaatagtatcattttgaggtcattcatataacttgaagactgggaatgacagacattttcctgttttgtttcttttctttttactttatctgaagagtctactagaatgcagtgttgctgcctgagcagcagggcattagctttgtaaaagctctgttccttggcaaccccaccactaatatgaagtgcagaacatttgaattgtctttgaccagcttcagcatcagcactattttttttttttgctagacccctagtaggtatttaaaagtacagaaatagaatttaatcatgctttttaccaaatgtgctatgctcttagagattctttcaacgtgcataaaaattctgcagtttcaccacataccagtaaaagaaactcagtcactcatttagccatttagtaaaaagaacaaattaactgatgagcatagtggagacctcaaaggtaaagaagacaatgtccctgaaataaagacaatcataaattttcaatcaaaataatgaaatttaggctgggcatggtggctcatgcctatgatcctagcactttggaaggctaaggtgggaggattgtttgaggccaggagttcaagaccagcctcagcaaaaaagtgagaccctgtctccacaaaaaaattttaaaaattatctgggtgtggtggtatgcaccggtggtctcagctactcaagaggctgaggtggaggatcaccagagctcaggggttggagactacagtgagctatgattgtaccactgcactcaaacttgcatgacagaatgagtccttgtctctaataataacaaaatttaatttttatagactgtgaaaaaccattatgtagatacagttcaagtacagtatgattttataggatagataacttttgcttgaaaatgtattcccaatttataggatagataacttttgcttgaaaatgtattcacaatagagttagtatttggggcacacctttatccatttaacaaacatgttttgagcactgccaggtagcaacacgttactaggcactagagtgagaaaagattacagttcctgctctcatggatctcatggtctagtcaactggaatgaaaggattacataagtagaggtaaagacacacatgatggaggatggagaatagtcaaaggtctggagaatgaccaggacgtcactgtgagttgtctaattgcactgaagcatggatgaagaattggaaagtcattgtaagaagcctaaaaaggtatctctcagggatgctatgaggttctgaatgttatgtacgctatttgggcttcaacaggcaggcactgagtattcagtataaatttttgagcagggaatccaccagaagaactatgcatctggaggattaatctggaaagattgtgtagaatgttatgcagtgaaagagtctgagatgaaacagttaggagggtgtattaataacataggtgaagtgtaatgaataaccaggctggaggaaaagcaataacgatggaatcaaccgggcaagaagtataacaattaggatcagtaaaatagaatttggattggaggaatgaaaaaaaaagggacaaaacaaagttgaactgctggtatccatactggaaaatacagatgtcattcaaataaataatgtaatgaatataagaaaccagttttaggagtgaagtggatgttggcttgaaaatatttcctttgaggtttcagtcaaatgaaaaggtcctgaaatgctacgtggtagcctaagaaggaagcgttcctagagagaaaaaaattagaaaagatttacatttgataatttaatcttttccttcatacaagctaaattgataagaaagtaaaacctatagttttcaccactcttttacaaatatccctaaccttttagatattcacatgaataattgagaaaaatctaacagatgacttgcttatgtcatttgtctgctttatccttaggttcctctggcttatatattgttcaataaaatacagatcattgatattgtacaatgtactgataatggggagtgaatccatgcttgtgcattcttttttttttttttttttgatttgcagagggcgtgcccagtcaacaagagaggcacaattgtttttatcatcacctcttctcatctaattccatgaaggagagtagtattaccatacaacagataatgagttggaaaacaagaaacctaacctcagaacttaaggcttggggaaaaataaaagagtaatttgtgtttaatgcctgtataacttggcaagagggacatataaggcttagtgatgcccaacatgtgcttagatgtggattgttagttgatgtcttgggggttctgtaatctaagctaaatgctcaaaatcaattaattgatgttagacacagagatctgctttgatccctctttatcgtatttctaggccttcccattctcaagagcctgagaaacgacagctttccttaataacttgttatttgtggtaggagatgaaactttgataaaaacacaattatttttaaatgtctctttttcactctaggctgttgtatgtatttcaaaaagttacttttgaccctttccagaatgagaaagcaatcaagaagattataatatcttgcttagttttctgctcaatttatcaacaaatatttcttaagcaattattaagctgagcagtgctcagcgctgtacttggtgatataggaaatggggaaaagactgtctttaaggcctttataatagtaattacctcaacttgtctgtttcttttccttaccatttcgccaaattcattgatctatcttgttctcaaagcaatcgccatagttatattgtaacacagcattttctagggtgtccccattaagttgagagtgttgacaagaaaatacaagcttatttatcattgtaaaacttgagacacctagtagttaccctaaattaaatatttgttggagtcagtcacactaaagagaacacttactgcattgaacaatttacctacattagacagcatttaaagactatgccacagcaaaggcccatggaattcttgtgaacacagaatagaagtgtattaaggaacaagcttaattctgttctcttaaagcacaacactttctcaaaacatattttgaaatcacctttgaccattttttttaactaataggtgggtgggagttagggtaggaaaacacaagcagcttcatcaaaacgatattctattttcttcaaatttgtggggaatcatacggcctctcaattttctacattatgctaattatgatattaatctctctgccagcaaatgaaaataatacatattagatgtagcaaatgtcaataatgacaaaattagtcatcatgcagatactcagggattcccaaaatatgtttggattatgattgctagctttgagtttgcccagaatcgtttcaataaaaataagggactcaaacacatttggagcaaaactcacatcataaattttagacatagctctgccaataatgctctcagttatattttcagtcctaatatttcctctgagttccagaccagtatcttcaactgtctgattgatactctctccttcatttctgtctccaatgcattaagtcctgtgtatttactttccaaatgccacttggttccatgcacttctctccatttctgccactgactcctcctcaatccaagcgaccatctttcctcactttaactaccatgatatctcctgcttggtctccttacttctattcccgggctcctccaatccattcatcctccagcagagaatgatgactagcaccttccacagtgtctggctaataggaggtatccaatcaataattgacttacagagtgaaaatataggcatggcaaataccagtagagaactacagggttttagaaccaatgacattagatacttccatcaaatatttacagtgtataatcaagttgacttgcacattgtcttatttttgaaaaacaattttgttggctttttctatatgcacacatacatattgtatcaccctctacccgccaaatggcttttgaagaagtatttatgtggctccaaattgataatacctctagagagaagagaaattagaaattttaaaatgacctatgcttcctttcgaatatcacgtcctgagacagtgttttttgagttacgtgcaatatgttccacgatgaaacatttaatgtgttcagaggcatgctagtaatcatgtagaaagaattttatgcctgaagtcacatgttctataaccaggatcacttaataagaaaacaagtacagctgtggacaagatgcctttttatcagggaaaggccaatttgttttctttgcaaatctaagtaaatggagagaaaaacacagcccttaaatgttttctatttgtcctgaagttctcatgaatgagttagaaggcgagaaggattaaataaatccttgaacgtagagagagctaacatttattttagcaaactaaaacctattcgctttgcaaagttctgttctgtactttgtaacaacagttttctttaaaacaagagccaccaattcaaatgcctttacagaatgattgaatgctttcatgccccacctaaaggcattcaaatcattaatcaaacaaagttctaacgccaaaacatgtctgggaccagatttaaaatgtagccctcagtttcagagggcaaaaacttaacatatttatattttcctcactttaggtaacactgtattgaatctctgcttgaaattgaggagcacgtgattttttctttttggcccagggcagcatttcttggaagagaaagaaaaacaacccaagatacccttacaaaacatgtagtacttaaagctctttatgatgaattaattttggtatacacattaatagcagtgataataacaaatctatatatatatatataattgatatgaataagataaatacatcaaaaggaaatttcattacaatttgatattaggtaaatgtcccattaaaataaattgctactgtacataattttccttcagttcattggcaggatgtttgctttggaaaataaacagtctatttctagttttagaaggaattctcattattcttttatagcaaccattatcaggagcagatgggaaattgtaccaagagcatatctactattatacctcacaggaaaaagagagtattaaatgaaatctaacaaggcctgctcctgactctagttcctgtaacaaatgaacacacacatttgtatggtttcagcatttgtattagtaaggtacaataaatgtttactgaaattgaaaaaaaaaaagataacaggagaaagaagaggctaaaaaggtgcattttatttctgatcgttcattgtaaagactgctcctttttaaaataatcaaattttattttatatacagagggtacatgtacaggcttgtcacaggggaatagcgcatgatgctgaggtttggggtacagatctcatcacccaaacagtgagcatagtacctacctgatgagtagtttttcaaccaatgcgcaccctccctccttcccacatctactagtccgcggtatctgttgttcgcatatttacgtccatatatgctctatgtttagctcccacttataagtgagaacatatagtgtttgtttttcctgttcctgcgttaatttgcttatgattatggcctccaactgcatccgtgcttccgcaaaggacatgatttcattctttttatgactatgtagtatttcatggtgtatatgtaccacattttctttatccaatctaccattgtttcacaactagatggattccatgtctttgctattgtgaatagcacaagacaggacctttttatttgactgagttccttgcaaattactaataaaagatctggaggtccttagttaaaagttgaatctgtagtgccgttcaaatttagagatgtattttctgttcaagagaagaaagccctcattcggtcatgcttaatattcagctgtaaagtccaaaacatatgagaatgacacaaatggaaacattttataaatacctatacaaaggaggggcacttagttcccctaggcctcttaaaagtcctctagaaagagggtacttttatgctaactattaaagatgagtaacgaatttgtcctatacaacttaacagtatcgtcaaggaagtagaaagttactcagttttactgggcattggagctaagcttgaaagtgaggaggagaagcggcaggagacggagccgagaaggcagtggggagaagaggaggatggtcctttccatgctccctgttgtactaacatgtttggatattatcttatacttcatatatggactggattcttgtccttctcattctgagctctccttgaccttgattcttacctcctataactttcattctttctttactcaaaaaaaggccatttatttcagccatttttcactgttttcttatccttcctagttgcttttctatactatttttccactcttttttttttctatactattttgcccttctctccattttcctaactgctagatttccccaattttagccatctttcaattgttctgactatcctcaggtgctcccacaaggttatcagaccttccaccaagacggaatccctcagtctatggacaggctaagttgaatgggtcctggtgctgtgcttagcatatgccttgagtatttgtgcatttattttgcttctttacaaaaatccatcatccgatagaagttgaaagaaacttgctgaagcacattaaaatctctgaaaacagtattggctatattttctaataattagcatgactggttaacttgctttatttatcattgaaaaaagtatcagaaactgtatatcaaactcctgaattcttggcactgacgaagagacacaatgagaatgaccttaggataaaaaaacaagataaagcaccatatttgtaggaaattgcaccataaaagtctgtttcacaactctcccaaatttcattttattacatcttttctcttgaccaatcagtaaactcggttaatgatttacctgtctcaaaataattcatgaacaaaattacaagtaaatctcagtattggattcttgaaacatctccttgttcaatgaagtttcctttttcttccctctatttccctgtatttatcttttcttccagttgcattttatctcttctgtttttttatcttgctccctagtttgtgattttttgccaattttttatttcctacataattcatccaatctgtcattgtacaatttcttataactgcttcttagcttattccttttcttcatttgtcacattctatttttcatctattgtgttttcatgcagttttggaaagttttacaaatagacttttaaaaaaatgtacgtaatgttttcatagaaaaggtagtggtttctttttcttatatccttccctgtataaaaataaaaatgtagcagttctttctttgcctatgtttcctctttccttcccccaatttgaccagacttgaaggacttagatatgtaacagtgttattttctataatttaggaacagcttttgacttaaaaagcagaagagaagttgaaaataatatagtaattctacatgtccttcctgcttcccaactctctgcacatgtttgtaacctcccctttcttttttagtgtatctctttcatatacctttgtccccagaaattctgattcagtagacttagaatggaattctgggcttttatattttgaaaagctccccacgggagttagatatgcacttcttattaagaatgaatgcttaatattggaatcaaaacacaataagctttctaactatgatgaataatccaacagatttaattatgattttctttttgtccagaaccaagactagatgttaattgccagagaaatagataagaatgcctatgacagcagtacattaatatgatatcaaagcttggaaattttattggtaatgaataattcagtacttaaaatatttagaagctatagaattaaaattaattaatgttgttcactgtgtgaataaagttgattgagattttacatttaattttgtaaacccagtgttatcttttccagctcagaaaacaccacatacaagctactactttctgttttgatcccttatttttctttcttatgctttatcactgaaaactctccttgagcaggccatgcactgtaaatatttctcctggttgcaaaaccttctcatacaaatgcagtagactgtgtaatgagctcttctttcacaaaattaaaaaaacctgaaagccctgatttgcgattctatacaaatgagatttagatctaacaattttaaattattgcttcactcttagctgttcaattctatctcttatttgggaaaccgaaataataaaaccattgctgattccacaattaggttgtaaaagtcaccgtagccatcagccatgaagcaaaagtgccaagatcaaaactacaaagcaaagaggctgagataaaaatgctgcagcattagtttatagcattataagcagcaataagaattccttgattgcttaacaaagactcaaaaggcatttactccattaccttacaactcaaagaggtattcctggaccagcagtattggcatttttttgaagtttgtaggaaatgcagaattttggtgcctccacggacctaatgcagcagaacttgcagtttagtaagatctccaggagatttgtatgcgcattaaagtctaggaagcaccgctatggtatacatctgatgtgtgcccatgcattttttaaaagtatgaagtaatagttgtaagtattggacactcttgaaggaacaaataagagccatggtctttactctctaaatacctccctgacatctatgttttaggcaaaatttttttcccatttcagtagtcactgatgcttgcacgatgcagtttattccaaaacaatggtgattctcatgtaatagttcatgttgccttaataatttacgttgcctcaagttctctgcccaggccccaatatacaccgagggctgtactcctcccctaacgcctgctctcatacagtggcatagagcccagttttatgctcttggtcacatcatggagattgcacaccacaggctttaacttctgccgtactctcactgcctctaaccctccatatgcctaagttctacgattctttaaattccaaattgacccagaagtctcctccgctcatccttttcactgagatcatccctcttctggcctaccatttgttgatcaccttgctttttttttatcctactgtatgtagtataacaaattatcacttgcaactgtgtcttattttttcaactagattatgtactgcctaagacctagaaaattgtgcttatttatttgaatctctaggaggatcagtaatgggtattaatactaatgactccatggtgatgatgagcctgaacttcctcccttcctttctttctacctctctcctttcctcccttcttttcttcctccattccttcctctcttcctccctccgcttcttccccacttcccttattcatagattcatgcgttcactcagcaaatgcttactgaaaccttccatgcatcagacattgtactaaacaataggaaactatcatgaataagacacaatatctgacctcaaagaatttatgatataaaagtaatggcataaaccgtgattacttttgcaccaacctaatatatagacacagtttgttatgactggtgtctctattactaagcaatgactgtcacatgcaacgctgatctgaacaggtggtaaagagtgagatgtaagcaatggagcaaagccaactagttacaaggaaatatcacatgtttactagagcacatctcatgggcattcaagagagtatggccaggacagcttgtgaatagttcagtaactgtgcatagttttatattcattgtgaggcaccgtgtcaccggtttgctgatttacagagtattttaattgctaactgtatgctaccaaaatttccagtattcgaaaataattttgcttgaatgtagaaaaagaaaaaagccaagaaatgtatgtgaaacgagagtctaagggagctttacctcagtctcagaaaacatgcattccttccttcatttaggaagcatgtactggggtctactgtcagcttgctattgtgtcaaggagtaggagaatacaaaaatattagagaatatgaatcacatctattaggagagttttctacatacgcacattattctgtcagtgacataaggatttgagtcattcagatttaaatacggtaggtacctcaagttctcagatattatttcattttctaaggttcgtatttagttaatatgttattttaatggccttacaaattctagattatcttttttaaaaagttaaatagaacgtaattgccatttttatttaatggtaaaaagcatttttgtttttgtgtgtacttggttgtaatattctccttttcaattgagctatttttctgatactttactcttaaaatttcattcaggaaaaaagtaaacaatatttaagcttgacaatcataaaaatgctctggtgactatagattattttaaaatttattactgtagcttagggatatcttgatgggatgctcctgaaagcaattaattctcagttttttgtggcttctaatgcaaaatacattgacgcagacagaatttgaaatgaattttcttctaatatagcaattaattttatttaaatatctctagagtttttttttaatactgtgactaacctatgtttgttctttttcacctctcgtatccacgatcactaagaaacccaaatactttgttcatgtttaaattttacaacatttcatagactattaaacatggaacatccttgtggggacaagaaatcgaatttgctcttgaaaaggtttccaactaattgatttgtaggacattataacatcctctagctgacaagcttacaaaaataaaaactggagctaaccgagagggtgcttttttccctgacacataaaaggtgtctttctgtcttgtatcctttggatatgggcatgtcagtttcatagggaaattttcacatggagcttttgtatttctttctttgccagtacaactgcatgtggtagcacactgtttaatcttttctcaaataaaaagacatggggcttcatttttgttttgcctttttggtatcttacaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggtagggcgacagatctaataggaatgaaaacattttagcagactttttaagctttctttagaagaatatttcatgagagattataagcagggtgaaaggcactaacattaaagaacctatcaaccattaatcaacagcagtaaagaaattttttatttctttttttcatatactaaaatatatacttgtggctagttagtggttttctgctattttaaacttgaagtttgctttaaaaatcacccatgattgcttaaaggtgaatatcttcaatatattttaacttcaacaagctgaatctcagttgtttttcaagaagattttagaaagcaattataaatgattgttttgtaggaaagacagatctttgcttagttttaaaaatagctatgaatatgactatgaagctaaaaaaagtgatagtgtcacttacctctagtttcaccacatttgtgaatacattcttgaaggggaacttgagccaaagaggtacaagtttaatggggaaaacaaaacctcaaaaaggttactgtcaaattcaatcatcatttaaatttcccttggaatgtattgaaggcacagaaagccaaatgcgtgctgctgcagttggaaagcctagagagtttataaatgggattttgtattatgcttccagttgttgatgttaatgtgtcttgtttcgtaaaggaagacttggcctttatttaccaaatgagactattgttatgaacaatgaaaacttcgttcttttgccaagctcttgcatcccacccatcatccacataataggtggattttaatattcaggaagctagaacaactcattgatgaatatctttcgttaagatgtattaaaaagaagattttggaattatgtcagttgtctttgcccacctcctctttccctctttattcatgttacattattcagaaagtagatacaattcatattttgtacaaaataaacacattagttgacctaaacacacacacacacacacacacacacacacacacacacacacacacacacacacacaccccttgccaaagttaaagaattatagcctcatcaaaagatattttgaataattaagtcttggttttgaaaatcttcttgattatagatagataaaataaagaactaaactttgtagttaaactacttccttaggtaagtcatatacttttttcccagattgaaattcttctcttaatcatacaagtattttattatttagataactgatgtgcttatactatgaacaggtataaacctgtataatgtcatttctgaactaggctcaatctaatccaaattaagatggtaagaaatgagaaaattaaaaaaattgaataccatactataaatatatatatacggagagaattcataaagtggattaaatcgactggaagattatttttctataatatataaagtattgtttcctattttaaatgtcttactcatatagtatttgaatagagtgtattaacattccctctgataactctaattcacctgaattttcaaaatcttgttatctgttattgggctctaaaggcacattataatttataaacaaagatgtagcaatatgcctgtttcaccaaataagctctaaaattttagatctttctaattttataagaaagtggtatatgctgactctgttgtgaaatagtatacaaattttaagttaattacagctagggatttggctgtaattaggaaaaaaattttcccatttaaacatgttgacctacattaaatattgcacttcagtgctttaaaaagtcaagttcagcttccttgagttttttttttaagctgagcttttaaagttgtctatttcacgctacattttaaaaataaatgttaacatatttaaatttccactgagaccacttttgtggcatacttcctcaggatttttatatcacttaaattttatgaaatgtaaaaatgtaataaaatataagtactggttctaccaatatactcatagctatttctaagcatccagtagcaaatcaagtaaaaattaataaaataatattttatgaataatatgttaacctaacaattaattatagaagggctgtaatcacgaacctattgctaatcaatagtgtactctcagtgcaacgcaagcagatgttagaagggaatagaagttatttattgcaccggtgaaaaatatataagatgcctattcaacttaacaacagtagtcttcgtttgtaatggactttaagtacagcggttagaaatatttaacattttttagtccagggacatcaatgaaagaaagtgtataaattcaagctagatgtctatatggagccctgtagttgcaaaactttaagtcttctgaaattttaagatattagaaataggaaaaaaaatctcaaaagttcaaataatagtggacatccaagaaggttagtctatgttggaagcaaatgaagtgtgaaatgtagtcagttagcgatgcagtttaagatagacaattcactacagcttcaattatgtaacagaagaactggatacatctataggcttaagcatgataataatgagtttaatgatggcgtagccaccaaaactgtctttgtacacgaaggaggtgcaaataaaaacctatcatcggctgtaaggggaagtcataggttgatacaaagcaagcctgtgtacaagtctttaagcaagcgtccatgaatagcaaggggcgccatgctcttcactggagaagaaaattacctatttgtctttactaacctctaactgaaattaagcattccttttcattttgaaagtaggcaaaaaaatcacagtagtacaatcagtacctatgaagtcacagatatgtacacatctcattacagttataataaatatatcaaaatatcatttatgcttatcactacttcaaaactgcagtacttattatatgtgctacagggtcttattgttgggctttaaaacattattctgaggaatgtcaggcttcaacagattgccaaagaagtccaaggcataaaaaaatgatcctagccagctgtctgtttatctgcccagaatctcatcctaatttactatggtttcagtcattttaatgtgcagtcactatcttcatacactccttttcttctggagtattctaggagaagacataccagtcgaggggttctggggagccaggccttcaagcaatggattgctgacaacataatgaagaggattttacttagaataatgtcagttgataaaagtttgaatgggagacggaagcaaggcagtgggaagtggaattcctaaattgaggaacctctgaatcataatccttagcaataataattaagatttcaaaacattataattctttcttcttttagacaagtctgatattgcttatcccatatcacagataaggcaattattctactaatatgcattaaggaatagtggttttaatttaagtgttaccttaatgaaaataattttgaattttttccttccccaagtctttttgtgaaaaatttcaaacatatagaaaaattgaaacaattgcaaaacatatgcccatttacactgttttcctccccctaaattcttagagtcaacaattgttaacattttgccatatatgctttttttctctcgctttctctaccctctttctgtatctctcatatatagggcatcacacacacacacacacacacacacacacactttttaacatttttgcaaataagttataaataccattatattttacccctaaataattcagcatgtgtcgctttgaaatacagacatgccatatataaccatgcctgtttattatgctctcctccaaattaaatataatactgcattattgttaatatccattccatattcatatttccttaatagttcaaaaatgtcttttatattttgcaggggagttagtaccaatatcttatcatggctcatgcattacatttggttattattatttttcatccttcttagtctaaaatagcccttccacatttttttcaccgatattgaaatttgaaaatgtccaggacgctagcctcaaaaaatgtctcatctttcaggatttgttttattttttttcccctgatgggatgatttaacttgttctgtagtctctgaatttctagtaaactggaagttaggtctaaataagacttcaagagatgcatgtcaaacatgtttggcgagaatacttcatatgagatgctgtgtattttgtattacgtcacatcaggaggtgcatcatatgaagtagtctcactaaatgctgcaaagttttattacttgcttcaggtggtgactgacagatcttgcattataatgtcacattttttcttcgcaattaataaatcatctaatggctttagtatccattgatgatccttccctaactcagttattacactggggcttgcaaaatggaggttttcctaatctgacatgatcttaacatttaccagctggctttcttctgtttgaaaaaaaaaaaaaaaaaaggtttttcctctatatttatgtcaaaatggactcataaatttttatttattcaatatattattatgaattacagttattattcttgcccagagcttcctgctcaattgtcccaggctcaccttggactttgcctatcccagatttagaattacccatttttttcaaggaactctggttacttttagaggtgaatagtacgtagaaacgtacatctgggtagtagccccttctcaatggaatgtgtgcacctttctggcaagcagtcccaaaggagataatattttcagattaccttggaaatgattcttgacaaatctctttcagaatacatggaagttaaaagtaagtctagacatgttaaaaagcccttcttgtgtgagacttcatgtacggtcattaagttactactcctttaaacctctctacttctgaattcttaaaccaaaatgtactagtatataatctatgctggtttgccatgcaaattaatggtgtaaataagataatgggaggcattcgtaaatgtacttaaaggaagaaattattgtttaaagaccttagctcattgtttgcatgcaaatacacgctgttgattagaaatgagccttatctaattcattaaagtaggcctggttggtcctcttcttgaaagtctccattagcaattcatattgctctatgcgcttccttgtaagacaactgttgtctcttaagttttctttaactttggcttcttacaaattcagaccccacccccaaccaaatagctttcaaccaaatagcttttcagcatcttatttcctacaaattaaaagcgaatattttaatgactcaaatggctctttacagtgtgtgcaatatgttaaatgtacccagtatatccgtgtgaaccagtgctacaagcctgctcacacattcacattttgcccccaggatctgtcccgtccgcttgctctgtactcaaacttcctttttttctcattgccagtttagaccttgactctccatccagcccagagtttggaaactgagtacccacaggctgaatcctgaatgcatgcagtatttttgcatagccactgtttttaaataattgacaacttttaaaaattgagagacctcattttttaaaaaaatatggatttctgtcttcttttgaaaatttagatctggctactaggcactcattactatattttctcttggcaccatcacctacaactgagtaacagatgtttcattttcttgctactcaaagtgtggtctctggtccagagcacagacatcacctgggagttgctaagaaatgcagaatctaataaataacagtcagcatttttaataagatttccaagtttccaagtgattcatgggcacattaaagtttgagaagcattgcctggggtaagcaagctttgtcctcagtttgcagcacctgtcccactttgctcatttatattaattgcttttccatagatatttgattttatagtacctcatgcagacctttgtatgatgatgacggttagggtggtgatggaagtgatggtgataacacttaatattgccatgcactgttccaagtgttttacgtagctcaatacttataacaactctatgaaatagttgctattctccttttaattttacaggagggcaacgaaggcacagactgataaaactctttgcccaagattgcacagccagcaagtatttgaaccaggatgcagtcccgcagtctgcctccggagtccttactctagatcagattttgcattatttatcccagttttgtccatcaggattctctggtatacacttgcaatttcttcctaccaaccttctccttacctttgatggccacacgtagtagcaaaagaattgaacatagaatctgttctgacctatctttccaaccctgtttttcataatttccactatttctgtttatgtctgaagctttgaatgacctgaagttttctgttcttcagcttttgcaaaaaaaaaaaaacaaagaacaaaaaacaagacaaaaaaaaaaaaaaaccgcttcctttggttgaattctctttccccttattttttttcccaaaatcttacacatcccttaagactcatcttaactgctattacctcaatgaattgtgacctgctcttctcaaacataagcagtttattctcttaaggttttcttgcccctttttataacactcatgtaatattgtatgtatatatcatgtatcatacctatttacatatgcttttcccccagcaagattaaaagcttcatgagggcagaggactctcttattgttatctctataacccacagtacttaccagaaagcctgatatattgtagatggccagtaagtactttcttaatttaaatcgtaagaattttattcacattcagattaaactgaagatttaaatctttacacttgacattattatatagattaaaaatagatctaaagagccagaccaatttttctgtttttatcatgttatcacatttccatggatacgtttgcaattctagaaattgaccttgatcccttctagtcttaaaaaaatggaaggagtttggttaataatattttaggtattcttcagaatttagtacatttaagagacaagtaacttcaatttatttagctagttatggcaaaaagcagctctttgattcaaacattttgtacatttgtttatcctactctcactgtatctcaactaataccttttaagtgaattaagcaggaattagccctgaaactgaatgttttagcctcatcctacatatagccacaagatgttttagatgcaatccatatcaccaaagagctatttttagattgatcagagagaatcatacagatattattattcacaggtgtcaatggaaaagctggtctcttcccatctgttctctgatgactcttgaaaagctttcaagggcattcataattcttcatcaaaagactatgaaaaatcagcttcatagttaattgttttatgtcatattttattttttcaacttggctagttctagtgaaacagactagctggcaccaaatatgttgttgcattggctggtaatgatgataccactgtgtggagatatacaagtgaatgtactttatttgtggccttccatgaactttatgtgcctgggaaagtaggagttagggagagtttgttagggaacgtgatctctgggatgggtcttaaaggatgagaagaggcaaatgaagagtaaatggacatgccagagagaaaaagtgacaggagcaaaatcactgaagcaagaaaaaatggcctacattgaaggactatacacagttcagtataaaaaggctctgttaagcaagcaccattgacttaccctaaactcttcattttctacatataaactgcccaattcccactccaaacctattgatggatattagtaacctattgatgtttttgaaaggtgttcaagtatcctttctggtaccatgtaccttggctcccaccatttgagagtatgttctccaagaggcaacagtctgtggttcctgacctggctatgcaagttattcttattattaaaattgtcctatttaattaaatatcatgaaaactaatgaaatagaaatgaaaagataagagaattgtggtttctatgaatactaaattgaatgctttggaagacttgataaaggtgattagaaaaaaaaaaaaggccagatgcggtggctcacacctataatcccagcactttgggaggccgagatgggtggatcacctgaggtcaggatttcgagaccagcctggccaacatggcgaaaccacatcgctactaagaaaatacaaaacttagccagacgtgggcctgtagtcccagctacatgggagtctgaggtgggagagttgctcgaacccgggaggcggaggttgcagtgagacaagatcatgccattgcactccagcctgggtgacagagtgaggaaaaaaaaaaaaaaaaaaaaaaccacggtgctgttgaattagatgtaggtaagacaactgtttaagattgggtatgagggatagaatccccaaaaaatggaggtattttgcattgagattattttcagcatctccaaatctgactgtaattcaaagaaaccaaactaaaagtcacagattatgaaatgtagaagtgttttatgcaaaaagtaatatgcttaacttcaacctgtgggcttttactccaggaaaagtctcggaccccataccaaatgagaagtaaatgagtgaccacttgtatattctaagaaaaataaaatgtttgaagatgtgtaaacacatttatataatccctccaattttacaatatttttccaaaaaccgcctatccacttaccctaatcaagtttgataaggggacttccttttatatgtaggaaggctgaaaaatgacgccatgacaaatgaaattgtcaagatggaccaggtcatggaagatttgaaatctcaaagaattttttccagggtagaatataaggatgttgggacgtttttatatgctttagatttgcatcctcatatgtccctttgacagttgagctcagagtgaaaaaaagagagtgaaactagtggcagggtgactcaagttagagacaatgagtaagcagaatagaactttaaaaacctgacagattcaagaaatacttgatgaaagtggaacaatttagtcgttaagtagatgggatgatgaggggaatgaagggacaattctaggatgatcccttttccaggttttttgcttgggggaactggctgcatggaaggctgttagtcaggataggaaatacaaaggagagtaactgaatggaaagaggaaagcaaatcagacatacagagctcaacttgggatataatagtcttaaggagctcttggaacattgaaaataaggtgatcagaaaacacgcatttgaataggtaagtctgaacatcaggaggaagacaagggctgaagacactgagccattttgctgtcaatgtagagatggtggcaatctccattgaactaactgcttctcaataaggtacctttctcaagtcattaatttgctaaccagtaaacaaaccagaattcccagagtacacattaaccattaagcactgctgtggaaaaggagttcaggtgtcaggaagccaacgtggcagatgagcactagtggtgacaaatgaaccaaagtgatatgggtgatctttatggggccacagagtaccactgtaaactatcacaaatcagaagggttgacaaacaaaatattggggataaatcagggaaaacctaccacaacatacaggaaaataagttcaaagatttcatcctacagattgcagataagaaatgagccctttttatttggggcaccctagggaaagagtagatgcccatatgtatatttaaagtatgaatacagcatttatttgaatatactgcaaatggtcaatacaagggtagctacagagcccataacatgaaaaggaaacacaaagaaatacatgccccagtcagactccttacttgggttgctgtaaattctctctccctttaaggttattgcatttaaagtctatctgttgattggacccaacagcagctgcaccaagactgtaccatttttaaaaaaaaaaaaaaaaaaaaaaaacaggccaaatggcattctgcatttattttccttgttgctgaagaaacttgaattgtctaccctcaaagcctgtcctttgagacacattttataattagaaacacttatttacaaagttctttttatgttagaatcacaaatcataacactccaaaaaaggaatacactatcctcaggtgagtgtcctacctttgtttacaaaagaaaacccaaagtcctaagagaaaaatgtgttgatcattttattgattccttaccttggtttaatatagttaatggatgtcttagatatgtataataagtctattatcatgttccctttaaaattctcttttgttttactaattatatgttgtcatagtttgaccattaatataagtctaaatttattataatgtgattttttctacaaaggttaatttgaattaaaatattttattttatctctctctactatgataaatgtttttaaaaatcgtttgtaaaatgaaagtactatatttgtgtaagctgccaatctaacaatttatcatttaccattatgatggtgaatgtataacaatccttatattcagcagaaagccttatctctcatttcagaggaatcttgccccggttaattattctgtctcttgaatgcacacaaacacaagcatatctttaccctttttctgctgcctcactatccctgatcaggtgaatgtttttagctcctagattacaatataaatatattcagacattcctttccaaatgcattcattccactgtacttgtcagagttcatagctgtgaataacagaacccagtttttgttgatagaagcggaaacggactttaggagaaagatacagacctgttcccattcctaaacaaagggatagaaaaccagctcaaaatgggcagaactcaaaaaagaggctcagctccaagaactatagtccaaatcataccctagattggatctcgaactcttggactcaagcgatccactcatcttagcctcccacagtgctgggattacaggcatgtgccacgacgtctggcccccatacactagatgtaaacgttgccatgcaccactctaccactgcagacactgggtgaagaatgtcattgctactggaaagaattctagatagtgccttataattctgtcactcattccagattcaaaaactgaacttcccccatcagattccatttgtatttggggattttgttcgacataatcagggcattcagattctgggcaaccaaagttaacaaatgtctcttacttcccctttcttgttattattcccatttgaatcttcttcatagttagtcactgttacttaaacacacattctctattatcacatttccctctcctctcttttgctgtttgcttttgatccaaaccactgctcagaaaccattattgccaataacaacaatgatttcttgtagttaaatccactggacatatcttagtcctattatccgtaggccatgtgccattaactgaacactttccgtattagcacttggtcctatcttatcttccaagtcactaatcttatctgaatttattcttacctctctatgtaattccttactatattgatgacactccttgctttacctgccccttacatcctgatgtttctctaggacatgttctgaaccctcccttcttctcattctatacggtttccctgattgttatccatagcaacaaatgtagctttcactgtatcaattagaataatatctagggagattaaaaaagaattatagtaactgaaacaaagtagaaatatattcatcttcttgtagaaggaatctgccagtaggtagtccgaggttggtatcattgctctatgatgttgaagatccagatcccttctgtctcacagatctgccatcctttggtgaggtccttacactcatggatcaagatgactatcagctctctatctatcacaactgcttttcaaaggctgcaaggtgtaggaagtggacaaaaaagggatacctctacccttttaaagggacttcatggaagatctacacaacactttagcttgtatgtcattggccagaatttattctcatgacaatgccaaactgcaatgggcattcaaaatgtagtggaatggatcatgggctaagcagctaagcagtctctaccaaagtcaccgatttcattttatggcctaagtctaatatttggcccaatatatagtttcagattagacctacatatgtagcttcaaatggaccatttcctcttctatgtctcaaagccatctcaaagtcagtatatccaaaactcaacatgttatattcctctcccaaaatctactgtgggtgatatcactatctattcatgtacccaaactataaatttggaagttacaagagctagtattaatgacactaagttttgtgcatttactctatgaacaggactttgataagagttttacaaatgtttcccacttaattgtcgcaatatctcagttatagagattttatacgtccatcatctcacctgactcttcgagatcataagcaaagcatggcagcattcttatgtccattttacaaattaccacattaagcacaagaaaaaacaagatatatgtccaaggctaaccaaagttatagaaggatcgagaactaaaagtcagtgatttagacccagatctgtgccttttcccttattgttacatatgaccatatctagctatgtgaacaaagcagctaatagtgacgacagggtagaacaaataagaaagtgaatattccccactacatttatgattatttgccagtttaacagcttcaagcctgtgtcttctcagatatgtgcttcctcttatgtctaaggaaaagtactatatttgatatgcttttatgaactttcttttttgagatggggttctggctctgtcactcaggctggaatgcagtggcatgatcacagttcactgcagccttgatctcccaggttcaagcgatcctccaacctcagcctcctgagtagctgggaccacagacacgggctactacacccagctatttcttttttttttttttttttttggtagaggcaggatttcactgtgttgcccacctggtctcaaactcctgaggtcaagtgatccacccacctcagcctcccaaagtgcggggattacaggcatgagccaatgtgattggcctgaattttttaaatttaattttattgaggtaaaatatacctctatataaataaaagtaaatatacctttaccatttttaagtatacagttcagtggtaataagtaaatttatgttatttttcccctttgtcccctctccctactcctatttctgatctctggtaaccaccaaggtagtgtctactttcatgagatccatgtttttagctcccacatgtgagtgacaacacataatatttgtctttctgtgcctggtttaccttacttaaaataattacctccagttctatccacgttgctgcaaatgacaggatttcaccctttgtatggctgaataatatcccatggtgcatatatatatatcacattttctttatccattcatcctataaattttaaatggtgtggaatttggagaatacttaaggaaaaatgacgattgtgtaaaaggaaagtatctacaaaagcaaggtttatctaccccataaagataacaagagaatctgtgaatgtggatacggtttctggagtgtttcagaggttgaaagattgtgaagaactggatgggtataaaaaaaagtgaggaggagaagaaatgaaagttctggaatgttctgtaaattgtagatgagttccctatattaattttaaaatgtaaattgagattataattattttttgatgatctatttttgctgggctgattctctgttggtgtaactctttaacgaatatgggtcacgtgggaccctggattttattagaattacatgtgcgaatcaaattctaactttatgagccaatataatgattgtttttttaatgattagagtctatccatgacaaaaacagcttgtttctcctactgacttatttggtgttttcttgctaattagcctttatactaggcagtagtaaatcagagtacttggacttcaggttggccattacataaacctggcaactaaatgctgggtaataatcacctatcttcccacctgtgtttattacctttggaagtatgtaacatggtatctttgcgtttatatttttaatttgttcttttttctcttgcaccagctacttaaattatctgagcttccttttactaatccaaaaataaagataatagtacatatttatagagatgttgtaagagtaagaggtaatgtaaataaattggctagctctatgcccagcacatgagtaggtgcttagaagttagtgtctgggtacatgacttctggggatgataaagtgagtagctcgataaatctccccaagaatcagtaaaatgggacacactggagaaaacatcttatgaccctggatatcaaccaacggcatatgctaaattaaaaagtgattatttataaaaagtactaaactttgtatatgaacaatatgaatttgtggtgtatttgcctgtattgcccccagtccccactcccagcttggtcaagcataatagttctatcaaggtagaacaagccatggaaataagcagcttcatcaccacagggactgattttatttgaagcagaagtttaaaactccatgtccagaagcattgtcagtaacggtggagacctaggcggcaaacaaaaaggcagaatagcaactcagctggcctaaagttgcagtcttgattggaacaagtaactgactggcagactggccagaaatttaatttaaccagcatatctgcaaaatgaggcagccgtaataggcctcagtaaggactccttgtgtctccttcatgaaaacttaaaatgtgcctgcatgttgaatataccctttaacacatataaagaacctttagcaaaacttggaagtcttactggcttgaggtatttaagatcaactgctggccaactattgactaatgcaaattaagctatgcttacctctaggaaactaggcatacagtttgtttctgttgtttgacagagaaagaatatcaacagccacacactgtggggaaacagattccacagatttcatctaggcaagttattaaaacttcaatttaaaaaacgctgggcataagaaggaacatcagaatttggggctcctttaatatgttatttaaaatgtcaaattttcaagaaaaatttacgatacgttcaactgtgacccattctcatggggaaaagcagtcaacaaaagttgtctctgaattggcccaggtattggcagatagagacttaaaggctcctactataaataccttcaaacaactgaagaaaagcatgtttaaataattaaatgaaagtatggtaacaataactacaaatagagaatctcaactaaaagatacacactatataaaagaaccaaatgaaaattctagaattggaaagtagaataaccaaaatttaaaaaaatcactaatggggctcaagagcagatagtaagacagaaaaaaaaaaaaatcagtaaatttgaaaatagataaataaaaattatccaatctgaatgtcagaggtaaaacagtataaaaaacgaacatgagtcatagctttgtgtcaaaacattgagcatatcaatgtagatgttacaagagttccagaaaaaaagagaatgttgttaaagaggcagaaaaattatttgaagaaataatggccaaacacttcacaaatacggttaagctcaacaaaccccaaatagaataaacacgaagagatcaataccctaaaacataagagtcaaactattgaaatagtttcatttgaaattattgaaagacaaatgggaaagtctttaaaacaaccagaaaaaaatgactcctcatgtacagggatcacatgattgatagttaatttctcatcataaacaatagaggccagaggtattgaaatgacatattcagagttctcagagaacacaaaattgccaaccaagaattccgcataaaacaaaactatccttcaaaaatataggtaaaataaatatattaccaagttgagaatgagaatatttcttgctagctgacctgacttacaagaaaaaactaaataaagtcattcaggctgaaaagaagtgatattcagtaactcgaacccaaatgaagagataaagaatcacagaactgataaatatgtagatacatataaaagactgtacaaatatagatatatgtttttcttcttttaacttctttaaaagacctaagattgcataaaaattataacattgtgttattgtgtttataagcaggaggagcaaaaatggagcttagcagagaaaaatatctaaattttactgtgttaaattagtttgaacttaagtaaattatgatcaattaagatgcatatgtaatctttagagcaagcactaagaaaataaatagttaaaaacaaaatttaaaattacacactaaaaataactaacaagacagtgcagtaaaggagaaacaggaacaaaaaagacatgaataagatgtgaaaaaatacaatatggcacatgtaattgcaactaaaagttgagaattcccattaaaaaaatctgaaatttgaaatgctctaaaatgtgaaactttctgaaggttgatataataccacaagtggaaaatttcacacctgacctgtaatgagtcacagtcaaaacacagccaaaactttgtttcatgcaaaaaattatttaagatactttataaaattacctccaggttatatgtataagatatctattaagatatatatatatacatatatatatatatacatatatatatatatacacatatatatatatatatatgtatatatatagtatgtgtgtttaaacttaggtcctatctccaagatattaggtatatgcaaatattacaaaatctaaagaaatccaaaatccaaaacacttccaatcccaagcattttggatatgggatactcaacctacatatcaatagttatagtaaatgggagtgaactaagcattccaattataggcagagatttcagacaggattatttaaaatatccaaccatagtttgtttaaaagagaaatgtattagagccaaaaccatataatttcaaagaaaaaagaggtactatgcaaattgtttacatataaaaaatgaagtgacaatactaatgtcagacaaaatagactttatgacaaaatatgtaacaagagaaaaagacatttttaattatataaggggtcaattaagcagaaaatataacaattataaacgtatataattaataggaaagtcccaaattctatgatgcagaaattgacagaattcaaaggagaactagacaattcaacaattattattggagacttcaaaccctactctcaatagctggcaggccaattagacagaaaaatagcaacaatatagaagaattcaccaacactatcaaccagcttgacctaactaacatttataggagacgccaccaaatgaaagcagaatacatattattttaaagtgcacatgaaattttctctgggatagattctatgctaggtcaaaaaacaaatctcaatacactcaacaggcttgaattcataaaaattatgttctcttaatatgtcagaattaaattggaattcaacagaaggaaatttggaagatatcaaaatattttgaaattcaacaacttctaaatccattggttaaaaactaaatcacataggaaattataaaatattttgaactgaataaaaataaaagcacaacatgtcaagatttataggatgtaactaaagcagtgcttacagggaaacttctagttttaaatacctattttagaaaagaataaaattcttaaatcattaactcaagctttcgccataagaaactagaaaaagaagaacacagtaagctcgaaggaagcataaggaaggaaataacgggggttagagcagaagtcaataaaatagaagaagaagaaagaaaaatcaatgaaaccatacattaatctttgaaaatattttttacatggagaagctttagctagactgaccaaaaaaaaaagaattaccaaaatcataaaggaaaaaggggtaattactaccaaccctacagaaattagaaagactagaatgtaataacatgaacaacattgtcaacaatttctgcaaaacatattaaatgaaaaaattcttagaaagacataaattaacaaaactgattcaagaaaaaaatagacatatgaatagacctaacacaaacacagaaactgaattagtaatttaaaattttccaacaaaaaaacccaggtccaggagaaagataggaatccgaggcatccacagtatagaagaagaaatgaaactctctttattcacagacaatacaatcctgtatgtagaaaaatctgatatccacaaaataactgctagatctgataagttcatgaagcttgcaagataatcaatatacaagaataaattacattcctgtgtactagcaataaaaaattgaaaatgatactaagaaaataatttcattctttgtagcataaaatagattaaatggtcataaatttgaaaatataagtactaaacctgtactctgaaaactgtaatacattgctgagagaaattaaaaatctaaataaatgggaccatattccatgttcatgaattggaagactcaatactgataaggtagtgattctccccaacttgttctatagatttaatgcaatctccatcgacatcttagcagatgttggcacaaattgaaaaattgcacaatcttggcacaaattgaaaaattgatcccacaatttatatatagcaattcaaatgtaccaaatagccaaaacaattgtgaaaaagaagaaaaaagttagaggactttgaaatcaggacattacctgatttcaaatcttgatgtaaatctgcaatgatgaagacagtgtggtactgtcataaggacaggcttatagatcacctgtaggtttaggaaacaaacctattcatatttttttcttaaatctactaactgcactcctaatgttgacaatggaagagactcgatagtccagcaataaactcttatatttatggtcaatcaatatatgacaaaggtgacaagataatccaatagaagaaaagcttattattgggtagcttattgttagtgtacagaaacagagctgattgttaatacaactcaacaggaaaaaggcaaataacttgatttttaaaatatttaaatatatatttctccaaagaagacatagaaatggccaacaggtatgtgaaaaggtgctcagcatcactagtcatcagggaaatgcaaatcaaaacctctgtgagatgaacactatcatctcacccctgttaggatggctactataaaaacaaaccaaaaacaagagataagaaatgttgttgaggatgtgaggaaatcggaacgctagtacaccataggtggtaatggaaaaatgatgcagctgctatagaacacagtagaaaggttcttgaaaaagttaaaaatagaactaccatatgatccagcaacctcactcctgggtatatatcccaaagaattaaaaccagaatctcaaaaagatatctgcactctcatcttctctgaagcattattcacagtagccaagatatcaatacagcatagctgtgcatggaagaatgcatggataaagaaaatgtggtgtattcatacagggaatattatttggccttaaaagggaaggacgtcctgccatatttgacaatatgtatgaacctggaaggcattatgctaagtgaaataagccagtcaccaaagggcaaatactgaatgattccatttatatgaggtgtctgagacagtcaaactcgtagaaccagagagtagaatgatagtaaccaggggctgggcgaagggggaactgggagttgctgttcaatgagtataaagtttcagttatataatgtaaataagttctaaagatctgctgtacaacatagtgcctgtactgtgcacttaaattattattaagaggatatgtcttaagtgttcctaccataagaagaagaagaagaaggagaaggagaaagtgaagaagaagaaagaaaaaatgaagggggcatgagcaaacttttggagttgatgcatatacttggttaccttgattatggggatggtttcatggttgtatgcttatatcccaattcatcacattgtatacagatgctcctcaccttaggatgggattgtgtcctgataaacccatcataaattgaaaatgttatgagtcaaaagtacattttcaattaatgatattttcaacttacagtgagtatatccagatataaccccatcctcagtccaggattatactaaatgtgtatcgcttttgcaccatggtgaacttcaaaattgtaagtcaaaccatcgtagtcagtcggggaagatctgtttgttaattatggacccatcgtgtacaccttaaatacttaataaagctgttaaatgaaaattaaaagttgactgggcacatggctcatgcctgtcatctcagtgctttgggaggccaaggcaagaggattgcttgaggccaggagttcaagaccagcttgggcacatagcaacattccatctctacataaaattaaaaatgtagccgactgtggtgatgcaagcctgtagtcctagatgctcgggaggctgagttgggagaatttcttgagcccaggagttggaggttacagtgagctataatcatgctaccacaccccaggagaccctgtctcaaaataaataaatagaagctttaaaaaatattggtatctcagtgttcctcattatccactgtatttaaggtttagctacttgtgcttgatgcttgacaaggtaatcttacttttctccctgatattggtatgatgcaaatttactatatatatgacacaaatttatatatgcaatattttctcgttaatggccttttattttactctcattttcattatgctttgccttttaagtcatatagcaaataaattatgtggcattttcttagcaactattaattcaggagaatgggaacagaattctctcatagattcagctggaaggtaatgatggtcagctcccagtggagaaaaaaaaaaaaactcccttcagttttcgtaaacatacagagaaattttctcctaagtgctatgtcagtctgctgtatgtcctattgatctgagaaccagaaaacacatattttagtttacactgccttgactctattgtacatggctaggtctgtttaaaaaagaaatccttgaagataccctttggattctagtattttaaaacggatgcttagctaagtgaagtggtctacttcaaggatcaaaaccaatcttgagtaatctgttaggtagactccctaagttcatctgtaccttgtaccaaatttttaatgaatttagtaattgacatggatgtaaaataaataatacactaataaagttcatgcagaatcaaattttaatgcccagaggtaatgtagaagatattacctgtccatttctctggacttagctcctgcaactctccatttttctctctaaactttagccacactgaattcctagtttcaattcctctgactcgctaagtatttcttctaccttgataaaagctaattcctttgtcttgtaccatctgtattccggctgatattgacatagttttcagggctcaatttcaatgttacttactcagagggactcactgttacaaccaccacagccttttcaatctaagtaagatccactgctcttcttagaaacaggttatattccaaatgactgtaagtgcttttgttcttagaacatatgtctccattcaaaagaccgatagatattcagttaagccctttgagaaaattataaatgttgaggaccttgattattattgttattattgcttcttttctatgttttcccaggactctcaacaaatttgctttgcttttgtactcatggcacataatgagattaataatgtttagaaaacatttcaaaaatacacacagaggagacacatcttagtctaaagttagacatgataccaaaaactataataactatagctgaccagtgaccccatttattcatggaaagtaaaatttgatgcatatttgcctttaggagcaacatacctatgaaagttctgaaagtgaaagtttgtaaaaaaggagtactctcctaacaatcttaatttttttctatatatatgtatggtttgcattaaactcttttgtatgattagtggtttaatgttgatgtcacccatgacaccataagctacgtgtatggactggctctgttttgttcactcctgaatatccagcaaaaatagtatagtgcctggcccttggtagatgtgtaataaatgtttggtgaatgcatagctacacttcaatgcttatcgcattttaatcccagctactcggaggctgaggcaggagaatcgtttgaacccaggaggtggaggttgctgtgagccaagatcgcgccactgcaccccagcctgggtgacagagcgagactccatctcaaaaaataaaaacaataaaaaaaaggagacccattcatgtatctgtatcactgactagcctgtcaacattttgttaactacctcatcaagtagcaaaatcagtacctggtatgtggtagatgctcaaatatttgttgataaaatacagtaagttaatgacaggcgagcttgcctcagtgaaatataatctgtaagtgagcagtgtgtatatcatttgaaggtgccctacttagcctagcatatcacagagattcccagtaaatatttaggcagttcattaactctaaaagttgaccctcatagtcattggcctacattattcacctccctctgtctctaataaattcattggcaaatttctgaactccaactggaatgtttgtggtggatttcttcatacctaatggattatttcaattttcattttacattgtattatttacttgtctgaggtctttataatgacaaactcggcatgcatgataagctgtcattacttatgccagttgacaaggacatattatttttctacaaaaaaaattatcttggccaggcgcggtgcctcacgcctgtaatcccagcactctgggaggccgaggcgggcggatcacgaggtcaagagatcgagaccatcctggtgaacatggtgaaaccctgtctctgttaaaaatacaaaaaaaaaaaaaaaaaagcagaacaaaacaaaacaaacaaacaggagtggtggcgggcgcctgtagtcccagctactcgggaggctgaagcagaagaattgctcgaacccgggaggcagaggttgcagtgagccgagatcgcaccactgcactccagccgggcgacagagtgagactccgtctcaaaaaaaaaaaaaaaagtggtaattgttcaaaatatttacttattaattcattttaaaattgcatgttgaaataaaaaataaatgtttagtttttaaactatctcttctacaacagaaacaatatagtgagaagagtgatcttgttttacatttttgcaaatctctttaaaagttagcttaagagaaggcagctggttcttatatctgtttctgcattgaatgtgctgtcatatctcgcatcatgtagcctctgaaaaactcataatagaatgagagaggaaaaagtcaaataacatcttagtattattacgaaaataatttggacctcacagaaccactgcatgggtctcagggactcccaggggtccccagaccacatttaaggaaatactgtttcagggaatataactatttttgtacctcctgtggctatattcttttaaagaatagtaacctctgtttctgaggaacttagctgcaattatgtgcagagtttaaataagtgaaacggaaataccctttgcctttctgctcgagtatgaaagtgatgatcaaaatgttcccttttctctctctctctctctctctctctctctctctctctctctctctctctcactctctggggaacttcgggtttccgtctctatataatgtattcatattccactggaaacatacatagtttgagaaaacagatgacattttttctgggggtggaaagaattactaccacgaggaattcaaaatacagacacagtaataaaaatcaccataaagcccagaggggaaaaaaattgagtaacaaaataggaggtgaaattataaaactgagtaacaaaaaagaggtgaaattataaaataaatgataaagttggttgtgggttaggaagaaagagaaatataaagaaactggcataatgtaaaagccaagacaagaaaagtgaggcagaggcataggtcttttgactattttccatgtttgattctaaggtaagtagatatagtttctcatagttggaaatgttcgtgaatttaaacagaattaatgtttataatcagatgcaatgtctagtttttctatttgtcctgtgaaataataattgtgtaaagtgctcatgattgtttcaaggggtgaggagtagttctaattatcatagatattttcatgacttcgcataccactggtttatagagattatacagattttcttatatcagaactctcgtatctttaattccctagtagatgtctaagaaggagatttatcacatagcagatggtggtaaacttgagtaaagtgccagatactaaatgcctttggctttgtgggccattcaatctttgctgcaactactcaactctgctattgtagcatgaaagtaaccatagacaatatgtaaatgaatgagtgtagctctgttccagtaaaactttatttacaaaaacaggtggtgagcacaacttggttcatgagccatagtttacaaacacttgctgtatagctttccctggttgaatttcgttaattttatacagaacctgcctcccatacacacacactttgttcttcatggaaaatctccccagactactatgaaataatgttattacttggagatatacaattaagatgatgtcattaggagattattaatataggaactaagcaaatactatatgctaagtactgaggatagggtgcgatcacaatagatagaaaatctgcaatagtttgatgaacatgggaaattacagtatttcctgtgatggaaacattatgaggggctgtgggactacataacaggacctgtgacctatacctgggttggggatgtctaattaatcaaggaaagctttgtagaggaagtgatgtctaacctgagattggaaaggtcaacctggagctacctagatgaagatgtatggaaggacatcccaggcagagggaacattgtatgatgaatcctgatatggatatagtgctggattttaaggaagagtaagttgttccatgaactatacagtgcaaagaaagatgaagaaatagaagtagagaccagatcacaaagggctttttgaccatgttagagaagttatattttatcccattggcactaggatgttgttgagtatatgaggacatgatcagcaacatattttagaaagatctcttattctgaagtgtaaagagtggataagaaggagacaaggtaggaggcacgagctaattagaaagcagtctcagagaggctgttagaaatcagaacagaatggctattattaaaaagtcaaaaaacaacagatgatggtgaggcttcagagaaaagggaatgcttatacactgtttatgggaatgtaaatgagtttaggcactgtggagagcagtttgaaaatttctcaaagaacttaaaagagagctgccattcaacccagcaatctcattacttggtatatatttaaaagaacacgaatctttctaccaaagagacacatgtactcacatgttcgtcgcagcactatacagtaacaaagacatggaatcaacctaggtgcccaccagtggtggattgaatgaaataaacgtggtatacatgcaccatggaatactacacagtcataaaaagcatacagtcacgccttttgtaggaacatggatgcagctggaggtcattatcctaagtgaattaatgcaggaacagaaaaccgaagatagttagaagctaaacattgggtactcattataaaggtgaaaacaatagacattggggactactagaagggggaggaaggagaggggcaagggttgaaaaactacctatcgggtactatgctcactacctgtgtgtggtgggatcatttttaccctaaaccttggcatcacacaacatactcaggtaacaaacctgtacgtatactacctggatcaaaaataaaagttgaaatcagaatgagaaggagcgaaggagacagcgacaggaggatggagagaagtgggcagattcaagagagatttctcaagtggacttatgaggacatgcttattgatacgctctgggagtgagggagagagaagaatcaaggatgacttctacactttcagcttaaaaaaccgggagctggtggagtcatccattgaacttgacagaggagcacgtttaggcaggaagatgatggtgtttgaatgtctgcgaagggaaaaactgaactgggattcaaatcagaaaaaacggtttgaagtcataccctcttaattgcattttctatcggatggtaatggctttgtgacaggctttactgataggtgatgtaactctgcctctgacagatgaagatccaaagcatcctcagattttcccgaagcctgtttcagcaactgtgtagacagcacacacaaaaatctggggggaagtcctagggctcagttagttgattggatctattaaagtagcattggagaacacagttcagtctgagatttcccaaacatattgctctataatttatttttacccagaaactgaattcgatgtgggatagggattataaaagccttcagattccagatagaatctctgaatagaaggcttttgggccacatctagtaatctcctttcctcactccatttctgaacttcttgttcacttcttcgctgtttttaggacgttcttactacactcctgcctcaaggcctttgtacttgttttctctgcttagggcgttctttcccgcaatatttgcatggcctcctccctcgcttctttatttctatattacctatctttattaaagctgctataaaaaaaaaaaagcccacacctcagtggcttaacataatagaaactttccgttcatgcaaactttacaaaaattttctggtcaacaagtagatttcctccaaatggtggatcaggggggcccagggcacttcgcttttgtggctctgatgtctttaacatacggatttcaaaatcactgtgctcttgtacataagaatgaaaaagaacaaggaatattacatatgtggtggtggttattggaggtggggttatgagccaggcttcatattcatgagcatcacttttgctcacactccattggctcgaactcagtcatgtagccaaactaatggcaagggagactgggaaatgacagctagctgcacaattaagagaaatgagtagacttgtctaatgagcagctagccagtccctaccacgaggactttgctcaaatgtctccttctccatggaaccttctatgatcaccctttataaaatcacaactgctccccatcttcccctcaatatttccatcccttttccatgcttcatttttttcctctgtaacacttactgtatcacaatctatagattttatttctttatcttgtttactgtctgcctccccttcctcccaatcggatgtaaggtccatgaggcagggattgctgccgatattcacggccatatcaatggacactagtagaccctcaataaatggctgttgcattgtgattacatatatgcttcacctagaagtagtctcatctggtggcacatttactcatagattgacattaattctctattgttttttccccagcaaaatttgtcaaggtagtttgtcagtagggagaaataaagttgtcaggtggctcatcaaaagttcaattttgagtactcctcctgtgtactcataatgttttataaatacttttatctatgtaagcacgtgggcttagacacaattctaggattaaaacagaaagctctgtatccatattttcccttttttgtacctccttttatgttctctaccattttttttgagtgctgttagtgaagcactaggctaaatcttgggtttctgcaaaaaaaactttaatcctcacaacactctaaaatgtttattgttctaattttaagacgaggaaactgagggctaaagagattaaggaactcgcccgtgttcacgtactcagctgataactggcagcatttagatttggacttactttccatacagatattcgcattgctaaccttcaggtttttccctcatcgttttccacatctactcaaaagttgctaatcatttccttaatagtgaggcataaatgactgagaaatcttgatatattatccccctcaggagcacttcattccgacaagacacaaactttagggaaaatgaacaaatgtctacttgtacaactcaagcaccaaccaggtatggtagacatgttggcttaaaaataaagttgatgcttgggttctgattctgataatgacctacggagggtatggcctgaggaggttactaggtgtgtgtagaaatcaatgttttgttttggttttccctcgggaagggtcaacttatacttgaatccttctgaagtttctcaaattacaagatggtcatttattttacttcaatcaaaacaacaaagtactgtccgggaaagatgtattgccttgacttattctcaatttatgcttattttggaggcttgtagaagtaaacctgatagaggagggcaaaaacacacacacacagacacacacacactgggagaaaataaatttaacacagtttagggattgactttggttgtatgacatcacaattgcaagagttggatgccattgtaaacaagctatggaaagaatactgttaaaagtaactcattaagtggttacatggtgtagctcatggacatatggcacagaaaaaagataaagctgtctttacataacataaaactgtattctgttatgtaaatgtgtgcttgtggcttgcagtaaaattcctagtgaaacattacctctagattcagcagtactatacctcaggccacatggatgtaagtaaagatgatgccctctggaaaactgagttaggcaacaacaagtgcatccatgaggatgcaaatttcaatgttgaaggtgcctgtgaagaatttgaacaaaattgttgcatgaaatatgaatgaagaagtgtgatctaatgacataatattttgtactatataattttaaagtagtacacacaatcaaattaatgaattaaacattatatgtaaacaggtgatcattgtatctccattttctaaagtttctatgttaaaggtgatcaaaaaacttggagagagggacttctcatttggaaaatgggatagtcacctttgggtatgtgatgtatcaatctctagaacttcagtttcttcattgaaagcatataaaaggcaatccaaaggatgtatggaatattaaaagattccactgtgaaactatctagcactttacctgaaacacttgttagatcccctcaccaaaatcatgccatgtgatttggcagtctattcctcttagcgtaagagtagcccgacagaaaatgttcattaagagttaatgttaaattcattgaatttagcaacacatgagtagcgcttcctttctgattatgcaaatctctcaccatcgtaatacgtgcttcctttaatttcattgggaacatttgtaatgtaaatggtaacagagccaatatttcaaacagaagccattctttctaaaaaaagctaaatgtctaaatgtattgaaatgcttctaaaagtaaaatatttagcacttatttgcagatgggtaatgttaaatatctcactcattattattactaccacttgtctgaataaatcctcccataagcattaagcaagtaggtaaacaaagaaataacacttcatgtgatgaatgccaatatgaagcacgtttaaactgttctgtcaagagacaagcctggaaatgctaactgtgtttctttgcttttctgcaatcatctgaatacataaattcaaattgcagcttttaaaacttcaaatcgaggcttttgaaatttcagaaaacacatgcgcttggaaaagcagattataacaaggtcccaacgggattttgtcaccatcttttttatatttcaaagtataaaaaaaatctagataagaaatgactaccaaatgttttcatatttaaaagatgctgtttttttaaaaaattaaatcactggaaaaaaagttttccacaaatatcgtgtaaaaagaaagacagcaaaaagcttagccaaagcttttactgtttaagtgatgatttattctgagagttcttaagagttttctaaattagtatatggttaatatccataaaatcatatgcaagatgctgtctttcaaattgatgctgaaggttaattataaaatgtacttaattatttatagtgtcccattgagtcccagatactctgtgtccaagaacactgtaaatacagaaagtttagcagaattatattggaaaggcagtaattcttcacaaattaacttattgatataatgcaatcccatttaaaaattttcagcgagaattgttttataatttgactgaatgatacattacataagttagaataactaaagtgggagagcgggttaacctaccagaaattaaacatattttaaagctgcaataattgacatagtgcattactgtcacaaaaatctacagtagatcaacaagcagaaacttaaaatatcatgaagaaagcaccataaatcaattcagaagagatggtgctgggggaaaaaatatcagtttctgaaaaactcttcaaggttagaaacaacactatataaatttaagatggattaaatatttggttgttcttttttaacaaatgaaagagtaaaggatcaagaataaatgagaatatctgaacaatggtaaaatggccacaattttaaggatactatcaatgaacataatatcaaagaaataaactgttaaattttatttagaaaaaactactaaaaggcaaaaaggaagctggaaacgtagtctcaattaatctatgtttcagataatgtgaaaagagctcttaaaaataggaaaacacaggaaaaatgggcaacagacattgccgataattgacagtggaaactaaataaatgacaaacatgtacacacatacaacattttcaactttcctattagtagaatacttaaaatatctatggcaagctttttatttgttttattggtatatcaattataatgctcaatagtggcaaaagtgtagtgagacaagtattttgtaactgttggtgggagtttacgagtgttctgagtaccaaccttgacagaaattcaacaatgtgtatctaaatccttaggattcccattgttaacttttcattctcattccagcagatacatgattcaaaatgtataaataaatgtgtttattgtagggttattcattataataaaaaatgaaagcaaacaaaattcctaataacacaataatggtgaaatatagggtacccctatatatcttattactaggatcttaaaaaatcaagtttttaaagcgtaattaatgacctacagagacacatagtagaataataaatgaagaaaataagcatacaatatagggtttgaacccagtaatacatataaatctcaactatgatgaataagcacaacatctctcctctgtactggatattcttgatagaaaaaaatatgctagtaaataatttgagacatatttgaaaagaggggagtgtttgatttagaattttctaaacttgagggttattattatttttttggtttgatattactttttcctgctccttaaatttttgtttgtttggggggtttggggttttcttttccttaaacgtgtctgcttctagatgaaagttgaaaatgtttaaaagccttgccaatgtgtctaggtttttcaaatgtaatcagattttagcaagattttacttaactaaaagtattcagaacactgtgcaaaatcatctggagtcaaatagtaatggaggcaatgatttgcagagtagaaacagagagagagaaaaagatgagatagaccctcaaaatctagacccaaggaattaaatctgcttggaacatttaaacaaataaaggatgcctgtactatactagacgttttcttcttccacaattgattctaaggtcagaatctgaggggaaatggtgctgttccacattctaaaacaaactgccagcaatcgagaccagccacttccccatagggtttactctaaagcaacagggattattatctctattccaagcaatttccaatctcctctgtactccgtgtcccaggcaagattaaaaagactcaggtaggaaggggtagtaagctttgtggggagtgcagtttgtggtaagggacagttccttctctttcatctctctgagtcagaagtagagacttcgagagaatcactgagagtaagtatgtagactccaagaaggaaaaagcatcctctcacttcaatgaatgtttggaatctgcagacctccttcccaggtctgtgtagcttttggagaggccagaagagcaccgtaggcattcctttggctttccatggccaagcacatagagtagaagaagaggaggaaccgtaaggttaaccatacataagaaatcaacaaaaggctttgaaattgacttttcctatttttcaatttaaataagagagaattgtcaatgattaaaattcataaaacgaagaaagaatggactcagaaaatagcaaacatgaaatgttaattattagttcaaaagttagtttaccgtgttttctctgccaactgattgctaatgactaaagtccttatttccagctttcctctctccccgagctccagatctcttgatttattaaactagtagtttccccaaaatatatgagacaacaaaatatactctcagctgaagtaaatagcattcatcttcccagtcagataaggcagaagtacttctagatcagatgttatattcgggataggttaaaaacagaccctgctcccagtgtcccaggaatgaacagtggatgtgcttatttctcattgcatgcgtgtatcaaaatatctcacgtaccctacaagtacatacacttactatgtccctacaaaaattaaaaacaataaatcataaacatttgtaaaaataagcgaataaatgtataaatgaatttaaaagagaatagacagaggggagaatgtaactttacgtgtcccagaacagactttgaacaggctcttatcatataggaaaactgaatgaatatatgcaagcataagtccaataaccagattctgatttacagaatgatcgcaactgtagttctctcaaggccctgtctttgaacaggctgtgtcttattcctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgatctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaccttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttgggttggttccaagtctttgctattgtgaatagtgccgcaataaacatacgtgtgcatgtgtctttatagcagcatgatttataatcctttgggtatatacccagtaatgggatggccgggtcaaatggtatttctagttctagatccttgaggaatcgccacactgtcttccacaatggttgaactagtttacagtcccaccaacggtgtgaaagtgttcctgtttctccacatcctctccagcatctgttgtttcctgactttttaatgatcaccattctaactggagtgagatggtatctcattgtggttttgatttgcatttctctgatgaccagtgatgatgagcattttttcatgtgtctgttagctgcataaatgtcttcttttgagaagtgtctgttcctatccttggccgacttttcgatgaggttggtttttttcttgtaaatttgtttaagttctttgtagattctcgatattagccctttgtcagatgggtagattgcaaaaattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctttgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacaaattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagtataaagacacatagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctgacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagagtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatcttttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcgtgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaatagaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcgcgtgcgtgcacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattacatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattcctttcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacattgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcccctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagcgttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacaatctcatttacctggtgtaacttcacttgtagcaacagaaatcaatagagagataacagacaaaaattgtcccctgaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgatcaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattgagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggctggggttgggtcgtacaatctaaactaatcccagttggctaaacatttgatttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaacctcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgccttatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaataattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttctttttttttttttttttttttttttttttttttgagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaagaggagaagactttaaggcatgaaaaaagttcctctgtattccatactgcatatttaactgcctactcaacagttccacttagatgtctcaaaaataatctcatgatcttttactgctatgaaatgcatgaccttcccctgatatattcctttcttcaggttttgtagcaccacttagctatccagtaacaaaatcttgggggtcattcttaaaaccttcccacctcacccctgctggacatccaccactaagttcagttgatttttttgctcctaaatatttcttggttcagctttcatttttagatttatcctgcatacccctgtacaatctcatcatctctttcctggactgttacagtagtcttatattaggatgatcatagtcttgatttgcctagagaaaacatgctttatgtcattgcctcagagtgactaatagtcccacctttcacttgtaacactatgcaggttattgggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaagaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgttgggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacgtaagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccaagcattgttaagcctctgcttatgtcatgtttgctgatacctcattagccgaaacaagtgacttgaccaatccatattcaaggagtggagaaacagactatggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatgccaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagatttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtagagtcattttaattttctaatgaatgcatgagaaaggtattatgctacatagtatgtcctcagactattcagatgccctctctctctcttgctctgtctctgtctgtctctctttacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacgggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcgtgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcttgccttgcttttcaatagattccctccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttctgcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaatgttagaactgaaacttagagaggttatgtggctttaccaaggtcccagagttcctagggcagagaacaggattgtctaccagacattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttctttttcttcttttttcctttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgggcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatccttttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaattgttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgtcgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgggttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccgatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtaggtcttactcattctttctaactaattttttgtacccagtaactatacctacaccacccccacctccccacgacccttcccatcctcaggtaaccatccttctactctctatgtccatgagttcaattgttttgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagactcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgtttatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaaaattaagaatttcaagatggcaacagtagagcatgaaaccaagtatgaatcccttctaatgcagatccttgtgtaactaactgcacaagttatacgttcaagaagctggtcctggttgaggtctttgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcatgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctatgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttgttgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcgccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagctaacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaaactcacagtccaatatttcacctgtattatcaattcaccattatcattagagtttagaatgctgctgtctctttccatctatcttctgttgtatctaataattaggagatatatatatatatatatatatatatagagagagagagagagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcagatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacatcccttgtaagttgtatttgtaggtattttattctctttgaagcaattgtgaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttatgtgtgtgttcctcacaacctcccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttacaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcagagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcgtaaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtctaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaagttggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggggtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtgtttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtatctttaaaatagaatggtttatattcctttgggtatataaccaataatgggattgctgggtcaaatggtatttctggttctagatctttgaggagctggaagccattatcctcagcaaactaacacaggaacagaaaagcaaatatcacatgttctcacttaaaagtgggagctgaacaatgagaacacatggactcatggaggggaacaacacacactgaggcctgtcggggggtggggcgaggggagggagagcattgggaaaaatagctaatgcatgctgggcttaatatctaggtgatgggcaatagcaaagacttggaaccaacccaaatgtccaacaatgatagactggattgagaaaatgtggcacatatacaccatggaatactatgcagccataaaaaaggatgagttcatgtcctttgtagggacatggatgaagctggaaaccatcattctcagcaaactatggcaaggacaaaaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatctagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctcttaaagaatgacaaaaagacattctctaaacagaaaggaaattataacgaagtcttgacatttcagaaagaaaatagtagaatgggtaaaaatgagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgttttttttttaaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagagtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctcacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattatagaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctgtgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctccttcagccctcaaggaccagccaaaatgttacctatctttgttgtctttcctgagtgtctacaacccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggtttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgctaggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaaatatatatatatatatgtgtgtgtgtttatatatatatatatgtgtgtgtatatatacatatatatatgtgtatatatatatgtgtatatatatatatatatgtgtgtgtgtatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgccagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaagaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccagagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaacaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaaatacaaaaaattagccaggcgtggtggtgggtgcctgtagtcccagctactcgggaggctgaggcaggagaatggcgtgaacccgggaggtgaagctcgcagtgagccaagattgcaccactgcactccagcctgggcaacagagccagactctgtctcaaaaaaaaaaagaaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactacggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatgaaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctagttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttgtgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataagtggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacattttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacagaaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgagccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcaatgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtgtagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcaggttctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaagactcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagctcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccctggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatacgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtagtagtagtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggcgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgactcggggcatgtttagtaaagccaatttgccagtcctgggcgggggcaaatcctcgaacttgatgtgtggggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggttgaatgtctggtggatcagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattttcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctggatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccagcacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgatagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgaccgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaaatttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctacatatggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttgcttcctgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttccctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccagcagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccggcctcagcagtgggacctaagatagtgcctgaatttccatgaacatttattgatgacaaagagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttgggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttttttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccggtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccatgatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgccgcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctcaaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatatacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagactttttttttttttattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcgtatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagagaagattgggagtctagaatgaactttgatgctgcatcggctcagtccctatgaaactaacattcttactagagaaagtggcctatggcacagtcataatcctttaccatctacatcttccccttgggatttctttctcagtatgtgcaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtcggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatatactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcctttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgtcatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcgtaaacatgcttactgtctctgtttatcttattctctctctctctctgtctcgcacgtgtgtgcactctctctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcattgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatatgtgtgtacatgcgtgtgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaatgtcaggatagtattagtcttgttgacagttatattctacagtacctaatgtggtatgtggtacttggtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgcgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacggacttacatggaaattagcccggtggcatggaagagatgagacaaatgtctgtttctttcttatttcatcttcctcattgtgacagattcttctgggcctcatgaggagctagggccaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagacggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagacaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaatgaaggcatttgtgagtttggcctggggtagcattttgtcatctgtcctagaatacaaagctttgcgcaacagaaatggtgggatcacacctctgtgggcaaaaattattgggggctgtcctgtgcattatctctggcctctactcactacatgccagtagcactcccctcccttagctgtgacaaccaaaaatgtctccagacattgtctgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagatggtcagtaacatagatcttgaaaggaaatatgttggagtgtgagcactttaagggcatagggcctgcattacttttttattaaaaataattttgcatctaacacaacatcttgcatattagatgcaggatatgccttgattgaatgaataactgggcacttaaaagattgttcccagtctaataaaatgaaagaacttagcctggtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttaccgcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaaatcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtctcaactgcacagaccaaagaggatgataatccccattaatctttgcatgttagtagaggcagtggctagtaacaaatgggagagactttggctggaggatattttttattctttaatctttatgatactgtttcccctctccccttctctctctactcctctctctgtcagctgtatccacaataatgccacaatataactactatacaagaatataaagcttctgttctcatgcttatgggtctacaggtcaactgtaattcgggtgatctggataaaacttgactggaaagctctacttcatactgaagcatgcctgggttcgcctctaggctgtgagttcagtttagatggtttctaaatgtgttgggttgtgagccccagactaaaggatcagaagcaacctggggcatgttctcatggcagattgccagtgtgacaagcctctgttcacatcatatctgctaaagcaagtcacatggtcaagcaagccaaggtcaaggagctaggaagcacactgcgctcaccatgaggccatggctaaggtatacatgtttagttctttcacaactgagtgaaaaatgggccccaaattcaatctctcctatactctttttgcgttaattgctagttctttctcactcttctcgctttctaatggatgtacatcccatctatgatcatttggtttttaatatctgagttgctccctactgtctcaggtttcaaattttactttccttgaaatttccctggtgcctaatacaatacctttcacacagagagcgttcagcaaatggtgtggactgcctgtcgtcttttaaaagtacatctgcagagacagtaaaggcacctggcgatattgcattgacttgttagtaacctgacttaacccagatggcccaaagactgtaaccaccattacctggaggaaagttccctggtaatgcagtcagccaattatgttcgaatttactcgaaaattccttgagcataaattattcatggctctatttatgtaggtatctatcttcctatatctgaccttaggaagcttgattgctttcttactcttctaataatcaccgtgatgtttttgaagttttctataagtcggttagaagcagcttttttttctttttttttttcatgagtaatgccgcccaactttggctattagactttgtgtgactgtgcagccatcagcactggatattagatatagttttatctctgcaactcagtcaccttgccaagaattttagtatgaactcttgacttcccagatcaaatgtgagcctgatactctaaatgacttggcaatctactgacaaatcccatggtgtggtattctgttcaccatgtgcaatggtctcagagctcagcattatctgtctgacagctcatataatatttacaggttgttattcgttaggaattttagttagccataaagattttcacagctatggcagacattagaggtctcattcatcactcttgtgaccttcctctctggaatgtagcccatctgtctctgctgttgaaatctttatggaaagtctgcccatctttgaaagtttagtaagtgatcttaaagttttcattgaatctttacttttgatatacgatatagacatataaagcactatccttattttaatttaacgttttgaaaagtgttaaatttaacttggcctttcatttaaatgacagaaaacttactcttgctacaggaactatatgcgtcacatcaaaagaaaatagaaatcatacagaaaaaaattggaatgggaaaaattacacatatatacatatatattcaacactaataactacatgaaagcttaaatactgtattataatcctgattatgactttaggaaatgaaaacgatagaaatacattttgcatataatttaacgttataaagaaaccctaagcaaattcagtaatgaagtgaactgaataggctgggttacagagcacaagagagggatgaccaacaatcagatgttgcccctttccatttctgttttcctctttttatacacaacttctcaaatgcttgcttcccctccgtctactccctccttcagcctctgatcactagtgtgaaattgcccttttgaggtcaccagtgatcgtgggatcaaatacatcttcttcttctacacccttagtctgtcaggctcaagaattgcttatacttcaccagctaggctgttcttgtgtttcatcccactttattctagcttctgtattatttttctttgacagcagttctactgccaccgccatttgggggcatttgccagggtacattcccttttgttttcctccactgtactcatctttttttttttttgtacttttatagctttcttggggtataattatatgcaaaaatatgcatatttaatatatgtaatttggtaagtttggacatatgtatacacccaagatactattgccacagtcaaactaaagataacgaacatattcattacctacaaaagttttgtgtccctttgcttttgtgtgtgtctgtgcatggcaagaacacaacatgagatggaccctcttttttttttttttttttttttttttttttgagatggaatcttgctctgtcgccaggctggagtgcagtggcacgatctcagctgactgcaacctccacctcccaggttcaagcgattctcctgcctcagcctcccgagtagctgggactataggtgcgcgccacctcgcccagctaatttttgtatttttagtagagatggggtttcaccacatcggccaggatggtctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaagtaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggctttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacaaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttctttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaagatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattgtaaatcaactggcagtgagtttatccaatggtgtcaaacttttcctattccccacttcagctttgtcttaataataatatgttccataaatgtaccgacttctatataaatataggcattttaatttctcttgaatctgcatcctttaacctcaaggaatggccttaattaaattctttgaaattcagtaaaaacatttatatttatccagagtcgactttagcctcacattcccctactaatgcttttcattttcatcttcccagtctgagaaattctaatcctttttagtcttttagtctgtccttgacggaaagataagctttccccttgattatcttagttgtttttccctggatcttttccagctctgttatatcttctttgggatgtcgtgactagggtggcccaaatattggttatgaaatttgttagcattgtctctagtttccactcactcatgaagaaagtaaatgttatttgctgtctcccattggtgcagaaatggagagatcaattgaggtcataacctcttctgcatatattagttctagccgaaggttggttttctgctacttttctgtaataccagcaaaagtgtttgaccttatatttctgccagctgtcccttaggaaggatttgatttttagacaagctggtcctttcctccttcaaagacgctgtggttgctaaatattgggaagaattcactaatgaaactcaggagtaaacctgctgactccatcagcagtaatgcatttcatcaggttccctttcgaaatatctctgaagcccttcacagaagagtgaaagatggggttcttgggaacttgctaactgctcagctttttttacatgcaatgctcaagaagcaactcatgtccaaaggagtgtttatcttttcctgctggtaattttgaatgttgtatatacattgctgtatatgttgcctgatgaccttgatcgacccttctcttcactctcaatctcaggcatgtttccacaaccatttattgcatctgagttttgctcacaactttctgctgcttcctgcttagcaaaatgcgatataaaaccttattggatgaagttaacagttgcttcagtcaacatttcttgttactgttgctgtttgtgctgacaaaattgctgatttgggttctgactgtcctgtcttcttatggcctaccattcctatagctctatttgtacgagtatttgactctctgcctggaactgtggccatctgtctagatttaccttttggtatatgtggctctctgtatcctgttggtctacattctggtttgaactcacggatcttggtctggtttttagtaccagtgttcccctaactccagtagcatctgaatcttgacaccaccttcccctgccccctactgtattgcctctattactactttcatggcaattttttcggattccaaatatgtcccatgcttaaagcatatcttgctctcattcttgttctagcccctgttggtaccaggcattgctccaattcaagttttggttggttgatttcttccttcataatattgattgctatttcagtacctgtatttatatacagagggagcagtgcctaactacatcttagccttaacagcaatcaacgtgttaaatatccctgtgttggctggtttgcagtagacacgtcttctgacaatgagatgggctcttattataaagaaactggagtatgatatcaacatagaaaacatttcctcaggccgggtgcggtggctcacgcctgtaatcccagcactttgggaggctgaggcaggcagatcacgaggtcaggagatggagaccatcctggctaacatggtgaaaccccgtctctactaaaaatacaaaaaattagctgggcgtggtggcgggcgcctgtagtcccagctacttgggaggctgaggcaggagaatggcgtaaacccgggaagcggagcatgcagtggacgagatcgcgccactgcactccagcctgggtgacagagcaagactctgcctcaaaaaaaaaaaaaaaaaaaaatttcctcatttcttattccagacacctcactcttctaagaatgatacaagtcttctgacattgggtttgaaaatcagttgaattttgtcataatctttcatacaatgtgaacacatcatgtagtatataattttgtgctatttctggtaagatccttcttatgtatatttttcttcaaaatataccttttagcagctaagacaacattaaataggggaaattttaaataggctaggcatcgcaagacttgaattctagttccagctttactgtcacctagctattaatacttgaccaatgggaaattgcttattttctgtgggcctcagtttctccctctgtcatttaaggaagcagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtgctgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccaggatatagtagccactgagtcttaacagaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcccgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatactttcttcaggaaaaatgttaacacggtaaaacactctctctctctctctctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattggagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtctttgcccatgcctatgtcttaaatggtattgcctaggtttccttctagggtttttaggatttggggttttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatatggagagagagagagagagagagagagagaggacaacgaagaggaaactaaagagaataaagggtattaacagcaggtctgtgacttattccctgggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacctgtaatcctagcactttgggaggctgaggtgggcaaatcacctgaggtcaggagttcaagaccagcctgtccaagatggtgaaccccgtctctactaaaaatacaaaaattagtctggtgtggtggcagatgcctgtaatccccactactcaggaggctgaggcaggagaatcacttgaaccctggaggcagaggttgcagtgagccgagatcgcaccattgcacttcagccagggcgacagagttgagactccatctccaaagaaaaaaaaaatcacacacaaaaaaatagatggcacggcacagcagcttatgcctgcagtcccaacactttgggaagccgaagcaggaagatcacttgagtccaggagtttgagaccaggctgagcaatatagcaagactccatctagaaataaataaataaataaataatttttaaaaaatagacaataacagataaagaagttccatgttatttttttaaattctagatagccccactggtgttacagtttattaaattacatttggaagcgattttttagcagtccatttattttgtatatttcagtttgttgagagcagatggggttgagtgttgatggggttgattgcctggctagattatgctataaactataaatctttgaaagttactgttttgaagaaagcatctttaagtgaatatattccttcagtagctcctattaccaaaactgttgtgagaatatcttaggaaaacaccttaaaatcctcttctatcaaaactcccaagctttcttcaggagccagcattgttcagtgaatgcatgtaagcctatgtcttaatagagggatccctaacctctggaccatggactggaacagcaggaggtgagtggtgagcaagtgaacattactgcctgagctctgcctcctgtcagatcagtcgtggcattagattatcgtaggtgcacaagccctattgtgaactatgtatgcgagggatctaggttgtgacctctttatgagaaactaatgcctgatgatctgaggtggaacggtttcatctcgaaaccatacccccgcccctgcctcccagtctgtggaaaaattgtcttccagaaaactcatgcctggtgccaaaaaggctggggaccactgtcttaatagatcttgaaaaaagttggagtaaggtaagtggtaaatcctaagacatacattgaggcagagctgcagtggtatccagtagggaagaaaagacttcaagtttagaattcagttatactcaaccagtttttgcctttctctgttaaatattagatatcattaccagacacatacaaaagattttaattgcatgaatgcccgatgttgatacaagagagccgatttttttttcacacatagttttttggggtttttttggtagggagaaacatcatctcatgatatcgttttaaaggtgctttattatcaaggaccttagagctttttctctcactcatatttcatatactcttagtcctcaagccatttctttttactgaaagcactatagagtagcaaaaggcatcattatattgctcagcctcattcatcatcaacaaaattgccaattatattccaagtccttgaatgtattgtttaaaaagatgtataaggtgaaaggaagcagttcaatgttgaggtggaagatgaaacatactgactggtagattcagagcatactaatcttgttttcacttgtgaactggaaaaaattaacatggagggatggagaaaacatgttcaaactacaaagtcattttttctgagaagttatctgactgtaactgtaactgtaactataactcagggtatatcagagggctcaaatgtggaacacttctttaaaattaaaacctaaaagtcctgatgtgtaatagaacgtgtaaaaatagcagcctctgaaggatctgagatgagcagaggaacactgaataatataatctgacagtatgggccatacccttacagtagttgccgtggcctggaaactatagaattaattcagtaaaacatcagaaaaaaagcaacataaatataaaatattttaaattaaaaagactgaataagaacagaaaaaaatcccctagcaaatcaatattgcttggggaagcatgaatcccagaccagcaatattttaatccaaataacttttagttccatcgtgaacacctttatcaccaagttttataaagagtggagtgaagaaaaaaagtacttgaggttgttggaaacacttctcaaagttggtggctttattcagagattcatgcttgactgtaccaacttctgtttaatttatacgtagtactttgtcaatttaggaatttggtttacttgtcctttcctaaatatgtgtattacaaaacaaaaaatagagaaatgataaaataattacaaagatgattaagcaatagtgttggctatagtgaacagattattgccattttatagagtaataatatacctaaggaaatctgtgggaaatttaatttgggatataaaacacagaagtcaggcggagatgaaataataaaccaataggaaattaaatttaggcatgagagtccaaagatgtaaattctatagatgttataaaataatatgtatgcccttacataatttcattactctctgaacttcatttctcagtgaaatatggggaaatgatactgaacagtgcagcagctcttccgcttatgaaccaaccagaagatatataaacaactcttaagggttatacattataaagatataatttagtctggatttttttttaaatttgaaaactaattttatataaaccctaattgggcaattctccattctttgacttgaatattatagtaaatatgttttcccaatttccaagtttcatgtattattttcaaagaaaaaagacaaacttttaaatgtccagctacctgggacttcctctgattatcttttaaggtagttcaaatatatacaatttcaaacaacaacaacaacagcaaaaaatattttgccagacaatatgtcttgtttgtttttaatgttcacaatgtaaagtacacttattgccaaacctcactttcaatggtgttacaaattagccaagtataactagtttgtaaatactaataagaaggttgctgaaattcagccctgaatatttcttttctgcaactccaaagaggaaaatttttgaaatgcaaaccttgacctttatcaaagcctaggtgaagtttgttggaggtgtttggttttttgctggtgctttgttataatgcagtttgaaagtagactagattggcaagacataattggctgctgtgtggagaatgcatttggtggaacacgtgagttaggggtgaggaaatatgaagagccagagtggaagcagggagaccagatagtagtgtgggaagcactggtgttagataagatctagataaaggtagcagtggagatcacaagaggtggttggaatcagggaatatggtttagaaacaatcacaggtcttgctgatgcattggaggtcaggagggacagaaagagggcaatccaggtgtctcctcggctttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatacgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaatcaaatattgcaaaatatatcactgtaaacaactggttggtcactagctttttaaatactttgtagcaacttggttgcttgtcagaggtcttctttgagtgaagtctttaatttatagttctttatgcttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctgtttccttgtgtggacacataaatccaaatatatctaatatcaaggtatttaccatatgcagcactttttcctcagatagttattttttgaaatattcaaatagcttacctgtatcatcccccccatccttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctatcatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatgtaagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggcatcagacaaggtttagtttaccactaaactttgggatttggaagatggtgtataaactgatacaggtagtccactcacagatgtagtatataattacagacttgagttttcaggggctcttctccagtttcctgtcaatcaatttccctggctgagacattagcatttgtcagtgaccatgcttactatatacatacacaattgtgtatacacaattgtaaaattaaatacgggctttagaagagattattttttcttaagagtaggttactctataaatgccaaagcatgtgttatgacatagaaattcaaatgactaagaatagctaattgtttagaaacatcttacttgatgtctattgttccaaaatttgatccaatttagagtggtaccaatccatggtgtagaatataaaagctaaaggataacaaaaatcctaggaatctcatgccagtaagaaagttctaccagtcagatgagatgttgagagcatttatgacttggcatcaggaatattataagtaaaattcatgtgagcagtaattgcagctatgaaccatgttatttgttcccacttgtccaactgtaattctttcacttagctcagagtagttctttgtaacattagggcccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttcttttcgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgccacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattctggtttcataaaggcaagtagggaagcattgcctcttctagtctctggaagagtttctttaagattggtatttctgccagtgatatgatttggccttggaattttcctagtgggaaaatttataattacagtgtttatttcttaaatagtacagggctattccaattttctatttcttcttttgtcagtgtcagttgacttaaagcacactaagatactctaagattgctatggtcagcctttgctggtctaaaccagaggttgcaaactgaaatgccaacagaggggctagcctgctactgtaactgggcaaggctagcgaagcgtaagttaatgggagctggtagggactatagaatacatgtgccgttatagaatggtggctccggaaagttattgtcatgcaagaataggagcccagcatggacaaatcattccttttaaatgagaagtcagaaggttggattattctgtaaaatatctctgaatatttaaatgttgagtaattcagattaaaaaaaaaaaaactgtgtgggctaatcaaaacatttgtgcatgccaaatttagcccaaagtctgctagtttgcaacttgtactttcaactaatgaaaagcgtaatagcacagatataattccattttcaaataatataattcatttatagttgacatttatttaatttacacttaaatatgaatttgtcatttaatttaccatattaaaaaagtttagattttaagacatccaagtctgcaaataactagaatattttcatttactctcatgtttgtgtacttatttttccttaaatgttattttcatgatatacttagtgtcttgtggacattccaaaaaactgatttgacttaaattgtcctcactccaagctttaaaattgcttagttcatagcctaccttgcctaaagcaaacctggtagtctcatttcaagttactggattttttgtttgtttgtttgtttgcttttgccttgtttcttttcaaggttatatagagtgaaggaatatcagacttcttttaatttttgcagggaattcagattgctgtggattaagatcctatatataagatgcttaggatagaggcatcatgaatgaaaaattattcatatgaacacactttttagagtattatttttattcattcagcaaataatcatagctgccatactaggcaggtagggaccatgaagactactgtccttgtagtctaaagtcttgtagactaataagatatgtataactgttaaatagtacactgaaaatacaaccttaaacaatcaaaatatttgcaaattgtatttagttgacatgattgcataattgtatttatgtgacaattatatttgttattcacatatttagggagtcaatatgtacttaaggtaatctttgagctattttcaggatgaggtattagctcattactattaatactaccatcaccaaatgcattacctacttatctgcatttccaggaaaaattcaggaaattaggatttttaaaataataaaataatagtaaataagactgggcatggtggctcatgcctgtagtcctagcactttgggaggccgaggcgggtagattgcttgatgccaggagttcaagaccagcctggccaacatggctaaaccccatctctactaaaaatataaaaatcagccaggcatggtggcgtgcacctgtaatcccagctactcgggaggctgaggcatgagaattgcttgaacccaggaggcggaggttgcagtgagcagagatcatgccactgcactccagcctgggcgacagagtgagactctgtctcaaataataataataataataataataataataataataaacagaataataacctaagtgactatatttgatatatagttaagtgatgtttttgtagactttactaaactaaaaaataaattagcagttatttaattttctagtttataaagtacctacttacataaagttgcatatattacttcatttaattttaaaagaatatcgtaaaatatgtaggatagatttccattttatagtcaacaatacttattatttcaatacattatgtgattttttttcccccagtatcacagtgttagagcccaggttcaaaccagcattttctaactgtaagtctggaagtctgtctgcttactctatgtaagatgccttatgaagttcatagaggagacagctcagtggattcaggcctggtcttatattttgctgttcatcttgttttaagtgttatgttaagcaaataaaacataactttaaacattctgtttacttttaaaatttgatttagagctaacaaaaattagaatttgtactccatttacaacgaacagaacaaccaaataagcaaaattgtatttgcgttgtcaattacaataaataattataatggtatatcagagtgttaaattttgatttttttttttttgagatggattttattttattttttattttttttttttttgctctgtcacccaggctggagtgcagtggactgcaacctccacctgctgggttcaagtgattctcccgcctcagcctctcgagtggctgggattacaggcacccgccatcatgcccagctaatttttgtatttttatagagatagagtttcaccatgttggccaggttggtctcaaactcctggccttagatgatccacccgcctcgacctcccaacgtgccaggattacagatgtgagccgccacacctagactaaaattttatgttcttatatttctttaaggaaagcaaaaatgttgacagagagggttaatactagttatatatacaaaaaacctaaaaataagattttggattattctattatatgattattcatttattgaaaatcataaactaattgaatgactgagagcagcactaatgtgattactttggtaggaatctgtcctccaaagttgtcagttgtcagttattcttagcattttgaactgaagtctatgtaattaagtcacctgttgtttctgacaaaatgagcaaacacacataaaatctcttggttcgtcttcatgtctctgtggcagagaactgaccacattattcagttcctttgtcctttttagacaaaagccacctctacatggccctataagtcttcaattcaaggactatagccgttatcttaatgggattgtacttggttatctgataaattgtcgggaacatacccacattgcttcctttacctgacataaaatttagtcagctggggctcaacgattgaccagctttatcttgcacgtagtgaagggaaggactttcttactcctggatgtgcctaaatttaagcctttgaaaaagattgaagataccaattggcctacctgccctaagtagatgcttcccacagacttaactggtgaagtgcttgtctaaggtagacagaattttttctttagagaggagcaaacaaaaacccaaaaatactggcgtgttcttttgatgttctatttcccaattgatttccgggttcacactactccacaacatcttactgtcccattgcatcttaaccctctctcctctcccgcccccactttttttttgtctgtttcttctgcttccaccgttgcttctgctctgaagcaatcattttctctcccttcaaccaagggtggaattggcacacagtcaattggcttgggagactgcttactgatctgtcttttttgaacactggaatcttgacactggttatcattttgaggacagcctggtttggatatttatctattaagaggaatccttaattggtgtctttgactggagtatttgaaggagtctttaattgggaggttttaaggcaccagaaaagattcattaggaatgactgacctcatgttatataaatgagaaatatttaccatttgctgtacacgtaattgaagcatgattatacataaaagcatataattaaaaaatgtaaataaatacctaaataaataaatgcctataactagcatggcaaaggattctgatatcagctttcaatctcttttagtagagactggacaaatcagaaaaagaggatttatacctgtcctcctatagattatgctttcttctcccatcatccagttttaattgaatctcctcattgtgctttctttcaatcttgagctgcacaagttgttttctcctgtcagagcttttaatacacattgacaagaattattagtctctatctgcagttgttccaagtgcaggtttgaaataaggagtcgtcatcaatgtgctaacgcgtgctacttttggtatttatacaaagtgcctgctgccagttacttgccacttagaatgtgtttttcttttcctctcttgcgttgtgggagtagaaggattctctgtttcttttggcagacagagaaattttcagattggggtctaatgaaagaaataggttccattatacagatgtacagatgttctaaggtcacgatacctcctataatattcttatgtgaaacctcctctttatgttcaacctgtgtacgttacacttatacatagcaggcatagtagccatcaatattagttactttaaaacccaggcctcctaggctgtggtttgtactaaaacatcatattcaaataaaagcattccaatacaaagtggagaaacagggacaggcatggtggcttaagcctgtaatcccaacaggctttgggaggccgaggagggcagatcgcttaatcccaggaggtttagaccagcctggccaacatggcgaaacctgtctctactaaaaatacaaaacttagccgggcatggcggcacatgcctgtaatcccagctgtaatcccaggctgagttatgagaatcacttgaacatgggaggcggaggttgcagtgagccgagatcacgccgctgcactccagctttggtaagcctcggtaacagagtgagactctgtctcaaaaaaaagaaagaaaaaacgtgtagaaagaaagagaggatctgattaagctcacaggaacattgcttctcaaattttaatgtgcatacaaattgtctgggaatcttgttaaaatccagattatgagccagtgggtctaaaatgagacatgatgttctgcatttctaacaggtgatgctaatgctgctaatctgtggaccaaccacactttgagaaggaaggaagtagactattatatttactcattcacttgttccatgataactcttaaaacagactggtgactttaatacaattcagagcaccaaataaagattgtcatatgccttatttttaacctatcgtcttatatcaaaattatctgataaacttcccaagtgtgcatatatattgtcattttaaataggtttcaataaaatgaagattcgtgagtaagaatataggaataaatgacattaaaatctttctttataatttatatttctactttcttttgaaagaatttgtagtggcttaaacataagagcacaagatgagccagtgacaggaaaaaccaagtgcatctgacatcttagcttattaggtctagaagacaacctccattacttggtagcaagcggctgggaatattggtgttcaaagctgtgctttcctgaaggcaaaaacagcatcaaaatatgaaaagctttttacttctggcatgagtgataaagatgccgatctgagaagcaggtgaaaaaacttagcttatgcttctaaaggctaattttatataagtgttcttgtccagctgttcttggtaagtccagctgctagttgaacaggacaggtggtaatccctgttcagtggctcattatcacccagaggctttgatctggctaatacataatcaatcagcttctgaatattaatattcttcctattttcatttcacttgttttacctaaatttattttccaaagttccagtatgtttttgttttttaataagatttttgatcatttatttattttgacataactaggctcatgatatgccagctggagtttattacacccctgaatcacaaactttttttcttccctctttatctccttacaagatccaaattgcaaaacctaaggataaagttctaattttggaagcacaaaagactgaaactattttagaggagagcgttaatgaaaatcaatatctaaaatcctcattttaagactgtgaaccctatagtctatacttctagtgtcttcagagttgtgatatgcatacattaaggactaagaaacatttttttaaatagtcagatttgggagcattagatatgtttgtagagggaaaaatcaatttatgataaaaattactgacaatggtttaatttgtattagttttgcccacttccctgttatctcagaatggcacctccatggacagtggaatggtcctaacagcctaaatatggtaagctttaaaaacagatggcttggggccattctgcttattatatcattgctttcaatagcataactgttcttctccaatggccctctttgttgtttgcttcattactggcacatttctttaatatgtaatctataacattaacatgaaaatggctctcaaatactattactttctccatctgtgacccagtactgtttatcatcatctaatgatcattcttattgcagatggccctctttaaatgtttcagaatagcattttaaagacattgagggtgcttcctacgtacattggcagactgaatgttttaatatcgaaaatctcggtctacacgatgtgtgataaatgactggagatgcaaggcaccagtcagttccaaagcaaggtgtaagagggacaggaggagagtgataaaaaagaatacatactttgcgtgtgtgggtgtgggtgtgtgtgtgtgtgtgtgtgtgtgtgtgtgtgtgtgtttaagccattagatttatctttaaggaagcattatctttaaggaaagttggagtaggaagaacaaaatttaatcaaaagaaacagttcttggccagaggaggtggctaatgccggttatccgaacactttgggaggctgaggtgggagcattgcttgaggccagcagttcaagacctgcctagtcaaggtagcgagacaccccacctctgccaaaaaaaagaagaagaagaagaagaagaagaagaagaagaagaagaagaagaagaaacagttcgttattgcagttcttaaagaaggagtttgtgtttcctttctgatcattcaccatggcagtgatacaaaggagtgatatcaaattgataaatgagttccctaaggctcaacatatactaaatgcctatgctgaacttccaggtttcaagtccctagagcctctctgtctgaagatcctatcaccaaggattctttgtcttcatctagtactttctttctcctctctctattctttcctcatttgcggatgcttgctggggcctgtcaatcaaacatagatgatccctgacttacaatggttggatttaggatttttttacttgataatgctgcaaaagtgatacacattcagtagaaaccatacttcaggtatccacacaacccctctgtttttcactttcagtacagtattcaataaattacatgagctattcaatgctttagtataaaataggctttgtgttagatgattttgcccaactgtaggctaacgtaagtgttctgagtaagtttaaggtaggctaggctgagctatgatgttgagtagattaggtatgttaaatgcatttttgacttagaatattttcaacttatgatgagtttattggtacataacctcattgtaagttgaagagcatctgtatctgggttggagcagaagtattgctagtaatgcatccatgagtcaactgtttgcttaattggtatgctaccacacatgtcttgagcttgttcatcccatggcttgccattgtgttggaaaggaaggtgttacagcattgccgttaataacatttctaaatgggaccaaaaacagtattttctttatctgctagatctttttattttcttctttctctgtatacgtgagctgttcccaaaatttagcacacatgttttatgattctcaacataacgtttatggtccttaacattaatctcatattagaaaataaatcatgatgaaggtgaaatatagaccaagcaggggcagttatgaggaccaaatcgtcagtataaaacttttataattaatattttcatgaattgatagcacttgcttcagagagctaaactcagaaaaaagagaaatattctaacctgaaaatatatttttaaaaactcataatttaaggtagggggcaagtagatttggccatattttgggctttcttcaccaattcagacacgataatgactacatttgtatcctagatttaaatttgctagatggaaaagaaacacataaatataaaccccatctgcgcaaacaaacataaccattcacattcttatgcaggattctggggtaggggagggctttttttgtattataacatagcatgttaatttttaagataaaatggaaatatttttgtgcttttgttaatttttatgttaaaaatgacattttaggcacctaatcaaattctctgagttctttcactaaagaattttgcctaatatttgattaaattcattattattaaagatcaatggaatttctttcagtttgaaaagttgaaaaaatgagttgacacattgattcatagaaaaagttatgaaatttgagaaaaattattgaaccaattttatttaaaatacatatagatattatgtgtatctgccttcattttcaggataatgaatgtcagtgttaaatgtggaaacattctaaaattggaaatcagactccacttggttcaaagaacaccttattttagataagccttttaaaataatgattgaaatccagtcaatccataccctcacacataatcctcatgcatgatctttgtttttccctatctctcctctaaatgtcctttacaaagatgagaaatgttcttcccaacacaaaattcctttgattgtatattagaaagaactgacactttgcagcaaggtttaggaaaagctaacgtaagtagagcttctctgaaaactgttttaccaaaacatactggatttactgctgttaaataatggatttttttttttttactatttatatttgctcctcattgaaacttgtaaatgactttattagtcttaggcaacacatttcattttgcattggataaagatgcttcttcagtaaagtgttcatttatagcattgagaatcttgaaatataaccggtgtcatcaaagggtaggaaggtagaggcacagagaagtgattaatcacttttccctccaatgaatgatctactgtcaagttcaataatcatatttcatctataaagagcactttgagcaaagcctgttttgcacacgtcattacatttgattacaattaagtataaatatatgcctattatttagctctagttaaaatctgcaaaaatatagaaggcttgtgggtgatgtaaattggagatttgcataggtttagggtacaatattagaaaacactgtagttttatttttgctttatgactaaaaggcactagctatgttatctcgtttgttcaccaaactaaaaaacaacagctaaaaagcaatgtaacaaatttcctctaaccttcttaacccatccactgctgtcgcatgactctcacaaatcagaaataaagaaccatttctctactgaaggtcatcaactcatttgagggccatagatcagtaaaaaataacttagtctgagacattcaaatcacttgctttttaggtaaatattttggcttttaaaatgacacaaatctgaccaaaatgttactcagctttatgggaacgggattcttttctagataatcttagggacgatcttaactcatattgtttttgttcagagactaggtctaatttgttagaagtgctgccatgggatctcattctactcaacaggagtgcattcttcttatccagtatccactaaaagtcactcctcctcccatgaaaagagttgccagtggaaaactcagagaaaacatgggaagggattggtgatgtcatataaggagattagaaaacatttttttaacgtttaaaaagtaaagagatgaattttaaaatttacaaaccaataagtttgatgttgatgagcaacaaaatcctggaaaatgacatcgtactgattattaatgattacataggataacatgctgctgggaatcagcgtgatactctcaaaatctgccatgtcacatgcacctcattttcattttttttatggctgcttgatggttagatgagaagactgttagagacagcataacttaggattttacaccacatttttcaagttctcttttgagaatattgggtacaagataaagaacagtggggctggctaataggctgaatttgaagctgattaaataatgacatctaaagaatgtcaattaatagatctagatcaacacaaaatagagtctctgtcgttggccctgcctttgcacatggctgtttcttcttcagtcatctcttaagctcaactcagccctctgcctgaagacctcatttggccagttttgcccattcattactactgtgaactctcttttgttatttttttcctgttttattctgagaatggattgagctagatatgtggaagttatgggaaagcatattttaactaaatattaaagaaacttttgtaatcgagctctccaaaaaataaaatccgccactttgaaaagcattaaactccctgtacagtagattttcaagactgaaatgactgtctcacccctaaaggcaatttctgtattggatgagaggatataattcattaacctttaaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcagtcaaatgacagaacgttcttactcccccaaaagcctccttgtgcccctttgcaggtcatttttcctttcacccctgattctaggcaaccactgatcgtctttctctcactgtgtattactttgcattttcaagaattttctataaatagaatcatacagtatttttgtatgtatctggtctcttatattcagcataatgattttgtttccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacttgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatctagggggattgttatatatatatttcaattagtatgctataatatttgccctaaccagcaatgattcaccatacaccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcttttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgctatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgtta

SEQ ID NO: 4465 - DNA, 1036241 bp, human; identical to SEQ ID NO: 4458
